United States Patent 12,746,261 (PROBIOTIC BACILLUS COMPOSITIONS AND METHODS OF USE) - sequence listing, part 16

SEQ ID NO: 262 - DNA, 3968902 bp, Bacillus amyloliquefaciens (residues 1,984,452-3,968,902 of 3,968,902)
ttcgatcattaatccgagcgcaatccctaaatagcccatacttgtcagccaggataatatttcactaataaaattgcccacactgttcacaacctctttatctttttacccaattatatgactgattgacaagcaaaatggttacaaattattttttaacgcacgatttttcagattctctttttaacacctcttctaaataagctaaaagtttcggtctcatttcttcccgcagaagcccgatctccgtgccggccttaaaacagccgaacttatctcctatatcaaaccggcttccttcaagctcccgcgcgtaaatgcttcgggtgcggcacacttcgcgcagcgcgtctgtcaattggatttcattgcccgcgcctcttccgatcgtcttcagcgttttaaaaatagcaggggttaatatgtagcggcccatcacggcaatatgagagggcgccttttcaacagccggcttctcaatcagatcctcaacctggtacacatgaccgctctgccgccccgtctgtataataccatatttgctgacatcagcaggatcgacgggctgtacgccgaccgtttctgtgccgtgttggttatagacgtctatgagctgtgaaagagcgggagtgtcagataccataatatcatcacctaagagaacggcaaaaggctcatctccgataaaatgctccgcacacagcaccgcatgtcctaatccgagcggttctttctgacggatgtaatgaatattggccaaatcggcaatccgttgcatttccttcagcatctctgtcttgcctttttcctcaagattgaattccaactccgccgaccggtcaaaatgatcttcaatcgagcgtttgtttctccctgtaataatcaatatatcttcaattcctgatgctgcggcctcttcgacaatatattggatggccggtttgtcgacaatcggcagcatttctttcggctgcgcctttgtcgccggcagaaatctcgttcctaaacctgctgcgggaatgaccgcttttctcactttttttctcattcatcttcactcctgatcctgtatgtttttcagcgaatctccaaatacccagattcggtttccgataaaattcatcatcattccgccgatagtggcggcgaacttactcaccaatagcgaacagccgcctttttgaaacacgtaaagcagcaaaaaggtgattcccgacgcagcaagattaatcatgagaaatcgcatgatctctttcccgtcagccttgcgttttacacgaaacgtccacttccggttccatacatagctgttgatgatccctgccgaataggagcagatctgcgccggaagataggggacatgacaagcggcgagaagaaagaagacaccaaaatcgatcagcgtattgccgacgcctacagtgcaaaaacggcctgctgtctttactttttctttcagcataacggtgacctcccctcataataagatgcggttcgctgtcctatttgttgatatggattactttagcggacagtgttgaataaacaattactaaaatatgaacaaaacatgaaaacgtaatgagactttgcaaaacttattaagttaacagtttgatagtttaggttgacatattccgcgaagggcactaatattctgtataagtgttaaccttaaatttattttggttaacattaattttcaaagtaagagaaaggaggggaatatatgcgggaagaaacctattacagcgtcagaatgagagcttcccgaaacgccccccatgagcagggcggaaaacacatttccggcggagaacggctcatcacttacagcggtttacaggaagcggtagatggcttattacataaaggcttctcgcactcaagagggatacctgattttatgcagattcagcttgaaagtattaatgaaccgatcgaaacgatccgccctttgccggttgctttccatcaaacagacacgccggaaaaaggacaagcaatcgcccgcaagcttctgcaaaaggcggggattcccccgcacatgatagagaaagcgtacgaaaacattgcggaatatgcagaagcaagaggagcggtcctgtttgatatccgggcaggaaaacgcattgacggcagaggaaatagaggtgtgcgggtatcacgagtggattggccgtcacatgattttcaaaaatggacttttacgcacaacatgccggaaaattcacgaataaaagaagcacatgccatcgcggcaaaagtttgcgcacatccggggattattgccgaattgtgctggtcagatgaccctgattacataacaggctacgttgccgcaaagaagctgggatatcagcggattgccaagatgaagaatgccggagatgaaagcggctgccggattttctttacagaaggctcaatagatacagagagctgtatccattttttagagaagcagcctgtattcattcagcgggaggagaacatatgaaacaatcaatgattgaaaaaagcaaacagcatctttggctgcccttcacacaaatgaaagattacgatgaagatccgttaatcattgaaagcggaaacgggatcatgctgaaagatatcagcggcaaagaatattatgacggcttttcttcagtatggcttaatgtacacggccaccgcaaaaaagaaatggatgaagcgattcaaaaacagcttgaaaaaatcgctcattcgactttgctgggtatgacgaacgttcccgcaacagaacttgccgagatgctgacaggcatcacaccggaaaagctgacacgcgttttttattccgacagcggagcggaagcaatggaaatcgctctgaaaatggcctttcaatactggaaaaacatagggagacccgagaaacagacgtttatttctatgcagaacggctatcacggcgatacgatcggagccgtcagcgtcggctccattgaactcttccaccatgtgtacggcccgctgatgtttgaaagctacaaagccccgattccgtatgtatacagatctgaaagcggcgaccccgtacagtgccgggatgaatgccttcacgcgctcgaacagctgcttgcaaagcatcacgaagagattgccgcacttacgattgaatcgatggtgcaaggcgcatcagggatgatcgtcatgcctgaaggctttctggcaggcgtacgaaagctgtgtacggcatatgatgtgttaatgatcgttgacgaagtggcgacggggttcggccgcaccggaaaaatgtttgcctgtgagcatgaaaatgtccagccggacttgatggcggcagggaaaggcattacgggaggctatttgccgatcgctgtgacgtttgccacagaagccatttatgaagccttctacgatgactacgacaaaatgaaaacatttttccacggccattcctatacaggaaatcagcttggctgtgccgcggcaattgaaaatctgcgtttattcgaatcagagtgcatcgttgaacaagtcgccgaaaaatcaaaaacggcagcggaatttcttcatgatctgaagcagctccctcatgtcggcgatgtccgccagctcggtttcatgtgcggcatagagcttgtgcaggataaggggacaaaacagccttatccgcctgagaagcggatgggatacaaggtgtccttgaaaatgagagagcttggtatgctgacacggccgctcggagacgtcatcgcctttctgccgccgcttgccagcacaaccgatcagttacaagccatgatctccattatgaaagaagcgatagccgaggtgaccggccgtggattttgacggatggctcctcggaaggctcgatgcggtgaaaagagacgggctgtatcggatgctgcgaacacaggaaaccgctcttaaaaccaaggggcaaaagcggcagacctgggcatccaatgactatttaggcctgtcaaaagatgaacggctgatcacagccgcgcaaacagcgctgagccggttcggagcgggaagcggcggctcacggttaacgacaggaaatactgtgtggcacgaaaaacttgaacaaacaatcgcggactttaaacagacggaagcggctttattattttcaagcggttacttggcgaatatcggcgtgcttgcctcactgcctcaaaaaggcgatgtcattttaagcgatcaactgaaccatgcgagcattgttgacggctgccgtttatcaaaagcggaaaccatcgtgtaccgccatattgatatggatgatcttgagaaaaaactcgcctccgtccagactcggaaacgccgctttatcgtcacggacggggtcttcagcatggacggcaccatcgcgcctcttgaccgcataatggcgcttgcaaagcagtaccaggcatttgtgatagcagatgacgcgcatgcaaccggtgtactcggggaaaacggcggaggaaccagtgactatttcggtgtttgtcctgatgttgtcatcggcacattaagcaaagcggtcggaacggaaggcggttttgccgcgggatcaaacattttcattgattttttgctgaatcaggcgcggacgtttatttttcagacggccctcccgccgtcaatttgtgcggcttcgcatacggcatttgacatcatttcagatatgcacgataagcgccgggagctgcagtcgtctgtcaaaaagataaaaacgcgtctggccgatatgggctttaccgtaagaggcggagatacaccgattatccccgttatcatcggtgatgcaaaaacagcggtttcagccgctgcactgctggagaaaaagggaatctgcgccccggccatccgcccgcccgccgttccggaaggcgaaagcagaatcaggctgaccgttacggcggatcgcagcttacaggatatagacgagctgacagaagcatttgattccattagaaaagagctgaatataaacaaatgagaagtttttttgtcacaggaacagataccggcgtcggaaaaaccatcgtttcttgcggtcttgccgcggcattccggcagaaacaggcggatatcggagtgtttaagccgtttttaagcggtgtgccgcggactcatccggaaagtgacacctcgctcttgaaagacatgtcacaaaccgcactgtctcatgaagaaatcacgccatttgaatggaaagagccgcttgcgccgtacacggccgccatgcttgaggggaaatccgtgagcatggcggatgtcatggcccactggagtaagatcaaaaatcgtcatgagtgtttcatcgttgagggggcaggcggcatttccgtcccgcttggtgaaaattacttagtcagtgatctgataaaagccatggaattgccggcggtgattgtcaccaggcctgatctcggaaccatcaaccacacatatttaaccgttgaatatgcgaaaaacatggggatagaggttctcggcattattatcaacggcgtaaggagcaggccggggctggacgaaaagacaaacccgagcatgattgaaatattatgcaaagttccgattttgggaatcacaccgaagctggatcacgtttcatcggaaaacattcaacacatgattgagaaacatatagatgtttcctctttcatgaatctgacacaaatggggagataaacatgaatcaatggatggatcttgcagagagagtgctggacggggcggaagtaacgaatcaagaagcgctggccattttaaattgtcctgatgaggatcttttattgctgatgcatgccgcttttcatatcagaaaacgattttacggaaaaaaagtaaagctgaatatgattatgaatgccaaatcaggcctgtgtccggaaaattgcgggtactgttcacaatcttcaatatcaaaagcgccgattgagtcttaccggatggtggataagcatatattgctaaagggggcaaaacgcgcccacgacctgaatatagggacatactgtatcgtcgccagcgggcggggaccgtcaaacagagaagtagatcaagttgttgatgctgtcaaagaaattaaagaaacgtacggtttaaaaatctgcgcatgtctcggtctgctgaagccggaacaggcagagcggctgaaacaggcaggagtagaccggtacaatcataacatcaatacatcacagaggaatcactcaaacattacgacctcccacacgtatgacgacagggtcaatacagtggaaacggcgaaacaatcggggatgtcaccttgttctggtgtcatcgtcggcatgaaagagacgaaacaggacgtcattgatatggcgaacagcttaaaagcgcttgacgccgacagcatcccggttaattttctgcatgcgattgacggaactccgttagaaggggtaagcgaattacatccggtgtattgcctgaaagtgctcgccttgttccgttttatcaatccgtcaaaagaaatccgtatctcaggaggccgggaagtcaaccttcgttcgctacagccgctgggactttacgccgcaaattcgattttcgtcggagattacttaacgacagcagggcagcaagaaacagaggatcatcaaatgctccatgatttaggttttgaagtcgaatccgttgaagaaatgaaagccggcctgcaatccgcctgcaatacggaggtataagatgacggcggacctatcgattgcacatccgtctctccatgcggattcggatttttggaatgacccttacccgttttatgacaaactgcgatccattgatcctgtttataaaggaaccgtattaaaatatccgggctggtatgtcaccgggtacaaagaagcggcagcgattttgaaagacattcggtttaaaaaccgcattcctcttccggaagcttcaacgaaatatcaaaatctatcgcatatccagcacgatatgctgttatttaaaaatcaatcagaccataagcggatgcggatgcttatcggtaaagaatttaccgcaaagacggcggaatcacttcgcccttgtataaaagaaacggttcatgacttgttggatcaagtccaaatcaaaaaaaccgcggaccttgtttcagagtttgcctttccattggcaagccttatcattgcggagatactcggagtgccgaaagaggagagatatcaattcagacaatggacggcagacgtcatccaggccattgatcttacccgatcaagaaagacgttagtcagagcaagcgacaccgcaggcaggctgacgtcatatttcaaagatttgattcacaagcggaaagcgcaccctcagcaagacttgatcagcaggtttattatggaggaacagctttcaaaagaggaagtgctcgcgacatgtatcttacttgtcatagccggacacgagacgacggtaaacctcataagcaacggtgtgtttactttattgaaacaccctgaacagcttagcgcactgagagaaaacccctcgcttattgaaactgcagttgaggaatgtctgcgctacgacagccccgcgcagctgacggcacgcaccgcctcagaagactgcgaaataaatgggaagaccataaaaaaaggagagcaggtatatatccttttaggggcagccaatcgcgatccaagcatattcgatcaacctcacaaaatggatatccaaagaaagccgaacccgcatcttgcattcggaaagaacgcccatttttgcataggctcctcattagcgcgcatcgaagcacaaattgcaattcttacactgtttgagcggatgcctaagcttcggctggctgcacaccgccttgaataccgcaagctcattggttttaggtcgctcaaagagctcccggttgtcattggctgaatgaccatgcaggagggccggattttatcggttcctcttgcaggaaataaatgaaagaaaaaagaatacatatttataaagcaaaaatcctctctgatccatctcactatccctaaaaaaactcactgctcagccaatcaatctaatacagcaagagtctccctttctttcgccaaaacggaacattcaccatgatgcacattttttcagcctcagaaacggtgcaaaaccggcatgttttttgctttattttctcgatttttttgtaagcgcttactaatattaagcagaaaagagggggatttgtggacattgttattattttattggcattaggcatgctgatgtttgcggcttaccggggcttttcagtcattttattcgccccgatttgtgcgctgtttgccgtgctcctgacagatccaagcttcgtacttcctttcttctcgaatatatttatggagaagatggtaggatttattaagctgtattttcccgtatttcttttaggggccgtttttggcaaggttgttgaaatatccgggctcgctgagtcgattgcaaaaacaatcgtcagacttgtgggagcaaaaagagccattctcgccatcgtcttaatgggtgcgattttaacgtacagcggcgtcagtctcttcgtagcggtgtttgccatttatccgtttgctaaaaacctatttattaaagctgatattcccaagcgtctgatacccggtacgattgcattgggcgcctttacatttacaatggatgcgcttcccggcacaccgcaaattcaaaatgtcattccgaccgctttttttaaaacaaacatttatgccgctccctggctcggactgattggtgcagcatttgtgcttacggccggaatgatttatttagaatcccggcgcaaaaaagcggccaatgccggagaaggctatgctggatttcaatctgaagtttccgctgcagaggaatcctcaggtctggctaatgaaacacatacgcctgttttaccgcaggaggcagaacccagccccgcgcggcaagtgctcgcctttgttccgcttatccttgtgggagtcatgaacaaatgcttcacgatgtggctcccgcattggtaccctgacggatttgattttgcgccgctcggcttagaagcgttcgggaagattgacctttcctccgtcacggcgatctggtcagtagaactcgcactgttcatcggaatcatgaccacgattttgttcgattggaaaaaagtcctcttcaatttgaaagaaggactgaatgagggcatcgggggtgccttgctggcgtcgatgaatacaggagccgaatacggatttggcggcatcattgcggcgcttcccggctttaaaatggtcagcagcggcatatcgcagacgtttacagatccgctcgtcaacggagcggtgacgaccactgcgcttgccgggattacaggatcggcatcaggaggaatgggcatcgctttaagcacgatgtcagcagcgtatacagaagcaatcaatacattccacatcccgccggaggtcatgcaccgggtgatctcgatggcctccggcgggatggacactcttccgcataatggcgccgtcattacgctgctcgcggtcaccgggttgacccaccgccaatcctacagggatatctttgccattaccgtcattaaaacagccgctgtgtttgtcatcatcgccatttacagtctgacgggccttgtgtagccaaaatagaaaggggaaacgaatatgggaaaaggaaaagtgatggactcttatcaagatgctgctgcactgatcaaggacggagacaccctcatcgcaggaggcttcggcctgtgcggcattccggaacaattaattctcgcgatcagggacagcggcgtaaaaaacttgaccgttgtcagtaataactgcggtgttgatgattgggggttaggcctcttgcttgcaaaccggcagatcaaaaaaatggtcgcatcctatgtgggagaaaacaaaacctttgaacggcagtttttaagcggagagctggaagtcgaattggtgccccaaggaacgctcgcagaaagaattcgcgcgggaggggcgggcattccggcgttttacacacctgcgggcgtcggaacatcagtagccgagggaaaagaacataagacatttgacggacgcacctatcttctggagaaagggattacagggaacgccgccatcgtaaaggcctggaaagccgatcctctgggcaacctgatgttcagaaagacggcgagaaatttcaatccgctcgctgcaatggcaggcaaagtgacgattgcagaggctgaagaaatcgtcgatgccggagagcttgatccggatcaaattcatacgccgggtatttttgtgcagcacgtgctgctcggcgggattcatgaaaaacggattgaacgccgcaccgtccggcaagcatgataaaggaggctgacagaatgagagatagcagaaaacgaatgatcaaacgggctgtaaaggaaattaaggacggaatgaatgtgaacttggggatagggatgccgacgcttgtagccaatgagataccgaatgattataacgtcctgcttcagtctgaaaacggcttgctcgggatcgggccttatccggcggaaggaacggaggaccccgatctgatcaacgcgggaaaagaaaccatcaccgaagtaaagggagcctcgtattttgacagtgccgaatcctttgccatgattcgcggcggccacattgatgtagcgatcctcggcgggatggaagtgtccgaacggggagatttggcgaactggatgatcccaggaaaaatgatcaaaggaatgggcggcgccatggacttggtccacggagcaaaacggattattgtcattatggagcacgttaataaatatggggaatctaaagtgagaacggaatgtacgctgcctttaaccggcaggcaggtggtcgatcggctgatcacagatttggctgtattcgattttcatgatggccgtatgacgctcaccgaactgcaggaaggtgtaacaatggaggaggtctttgagaaaacagaaggtcattttactgtcagccagtcgttaaaaaacggggtcagaccaaaatgaggaggtgccgtcatgcattcattgcttattgaaaaaacagccgttgtaacaggagcagccggaggaatcgggcttgaaatcgcaaaagaattcgcccgtgaaggagcagccgtcatcatctctgatgtaaacgaacaagcggggaaagaagcggcggcaagactgaaagatgaaggctgtgaagcagtcagcatcacatgcgatgtaacaaatgaaaagcaagtggccgatatgctgcagacggtcgagaaacaattcggacgtctcgatatccttgtgaataatgcgggcattcagcatgtcgcgcccatcgaggaatttcccaccgaacagtttgaacggctcattcgtctcatgctgactgcgccatttatcgcaatgaagcatgcatttcccattatgaaaaaacagcaattcggtcgaatcattaatatggcgtctgtcaacggactgatcggttttcacgggaaagcggcatataacagcgccaagcacggcgtcatcggtttaacgaaagtcggcgcacttgaaggcgcggctgacggcattaccgtcaatgcgctttgtccgggatatgtggacactcagcttgtccgcaatcagttaaaggacatttccgcaacaaggaatgtaccgtacgagcgggtgcttgaggacgtcatctttccgctcgttccccaaaaacggctgctgtcagtgaaggaaatcgctgattacgccgtatttttggccagcgacaaagcaaaaggggtcacaggtcaggccgtagtcatggatggcgggtataccgctcaatagttcttatactttttaaaaaagcagccgctctgaacggctgtttttttatgcctgaaaaccttgttcactcaataggccgatttactgcgtcaatcggtatccgggcagggtcattcgcatgttctgcggcgtatttcgtccttgcggattttccccatccagatccatctcttgcgccacatttataaacaagcgcaatcagtttacaatccttcacagatatacaaatgattttttacaataaacagaaaatatgtaatttctgacacaataatgccaatagccctaaaacatatgaaacatgaagagcgcgtcctaagtgaagaagagccggtaacaggctccaccccggctttcatcatctctctttaagactgattttcggtgaaacccccatgttttattttatgaataaatatatctaattcgtttgtgaaaacgaacaataactcctccgaaagtattctatacacatttgttataatcatgctaggatgttagataaagggatattttgtaggatattgtatcccctgttcaatatgatcggaggaatctcatgaacaatcttgcctttttatttcctggacaagggtctcaatttgtaggaatgggcaaacaattttggaatgattttgtgctcgcaaagagattgtttgaagaagcgagcgatgcgatctccttggatgtaaaaaaactgtgttttaacggagatatgaatgaattgacaaagacaatgaacgcgcagcccgctattttaacggtcagtgtgattgcttttcaagtgtatatgcaggaaataggggtgaagccccgcttcctggcaggccatagcttaggcgaatattcagcgcttgtctgtgccggcgccctttcttttcaggatgccgttacacttgtaagggagcggggaattcttatgcaaaatgcggatccccatcagcaggggacgatggccgccgtgacacagctctctctccaaaccttgcaggaaatatgttcgaaagtatcgacggaagactttccggcaggtgtagcctgcatgaattcagaacagcagcatgtgatttccggacaccggcaagctgtggaacgtgtcatcaagatggcggaggaaaagggtgcggcatacacttatttgaatgtcagtgcgccttttcacagttcgatgatacgatcagcctccgaacaattccagactgtattacaccggtattccttccgggatgccgcatggccgatcatttcaaatgtcaccgcgcgcccttacagcagcggaaattcgatcagcgaacatctcaagcagcacatgacgatgccggttagatggacagaatcgatgcattacttgcttttacatggagtcacagaagtcatcgaaatgggtccgaacaatgtcttagccggtctgctgagaaaaacaacgaatcacattgtaccttatcccttaggacagacatctgatgttcccccgctttccaattcaacggaaagaaagaaacatattgtccatttacgcaaaaaacaactgaataaattgatgattcaatccgtcattgcgcgaaattacaacaaggattcagcggcttattccaatatgacgacgccattatttacgcaaatccaagagctgaaagagagaatgaaaaggcatgaagacgtgctttcagaacaagaactcgaacattcgatccatttatgcaaattaatttgtgaagctaaacagcttccggcttgggaagaattgcggattttaaaataaagcgcccaggaggggacctatgtataccagtcaattccaaaccttagtagatgtcattcgggaaagaagcagtatctctgatcgcgggatccgttttatcgaatccgataaaaacgagacggttgtctcttaccgccaattgtttgaagaggcgcaagggtatcttggctatttacagcatctcggcattaagccgaagcaggaaattgtatttcaaatccaagaaaacaaatcatttgtcgttgctttttgggcttgtatattaggaggaatgatcccggttccggtcagtatcggagaagatgatgaccataaactgaaggtctggcgcatttggaatatattaaatcatccctttctgattgcctctgaaaaagtattggacaaaataaagaaatacgctgcagaacacgatttacaggatttccatcatcaattaaacgaaaaatctgacatcattcaagatcaaacctacgattaccccgcttcattttatgaacctgatgcggatgaactcgcctttatccaattttcttccggatcgacaggagacccaaaaggagtcatgttaacgcatcacaacttaatacataacacgtgcgccattgggactgccctacacgttcattcgaaagactctttcttatcatggatgcctttaacgcatgatatggggctcatcgcctgccaccttgttcccttcataaccggaatcaatcaaaatctaatgcctacagagttatttattcgcagacctattctttggatgaaaaaagctcatgaacataaagccagtattctatcatctcctaatttcgggtacaactacttccttaaatttctgaaaaacgaaccagactgggatttatcccacatcaaggtcatcgcaaacggtgcagaaccgatattgccggagctgtgtgacgaatttttgaaaagatgcgcagcattcaatctgaaaagatccgccattttgaatgtttacggtttagcggaagcttcggttggcgcagcgttctctaaaataggtaaagaattcgttcccgtttatttgcatcgtgactatttaaatcttggtgaaagagctgtaaaagtcagcaaagaggaccaaaattgcgcttcattcgttgaggtgggacaacctattgactattgtcagcttcggatctccgatgaaacaaatgaaagagtagaagacggaatcatcggccatatccacatcaaaggagacaatgtgacgcaagggtattataacaacccagagagtacggaaaaagcgctgacttctgacggctgggtaaaaacgggagacctcggatttattagtgaaagtggtaacttagtcgtaaccggaagagaaaaggacattattttcgtgaacggaaaaaatatctacccgcacgatattgaacgggtcgcgattgaaatggaagaggttgacttaggaagggttgccgcctgcggtgtatatgatcaaaagacacaaagcggagaaatcgtgctctttgttgtttacaaaaaatcacctgaaaaattcgcaccgcttgtcaaagagataaaaaagcatttgtacaagcggggcggctggagcataaaagaagtccttccgatccgaaaactccctaaaacaaccagcggaaaggttaaacgctacgaacttgccagacagtatgaggcagggaatttttcaacagagtctgccgccatcaatgaatgtttggagagcagcccggaaacatccggacagacacccattcatgagatagaaacggaattgctgtctatcttttccgaagtgctcgatggaaaaaaggttcacctcgctgacagttattttgatatgggagcaaattcattacagttatcgcagattgccgagcgcatagaacagaaattcggacgcgagcttgccgtttcagatctctttacgtatccttctatcactgatttagcggcatatctgtctgaaagccgggctgaaatcaaacaggacgcggcagcgaaaccaagccatgtgacaccgaaagatatcgccattatcgggatgtcgctcaatgtcccgggagcgtcaacgaaaagtgatttttggaatctgcttgaaaaaggtgagcacagcattcgagaataccccgaatcccggctgaaagatgcggcggattatttaaagtccatccaaagcgagttcaatgagaatcagtttgtgaagggcggctatttagatgaaatcgaccgctttgattactcgttcttcggtttagctcctaaaacggctcagtttatggaccctaaccaaagactgtttttgcagtctgcatggcatgcgattgaagatgcgggctatgccggcggcagcatgaacgggagccgtgtcggggtatatgcagggtactcgaaggtgggctacgattatgaacgtctcctttctgcgaattatccggaggaacttcatcaatatatcgtgggcaatcttccttccgtgttagccagccgaatcgcttatttcttaaatttaaaagggccggcggtcacagtggatacggcatgctcctcatcgcttgccgccgttcatatggcatgtaaatctttaacgtccggcgattgtgaaatggctcttgcaggcggtatccggacatcgctcttgccgatctgtatcgggcttgatatggaatcttcggacggatacaccaaaacgttcagcaaagattcagacggcacgggcacaggtgaaggcgcggccgcagtcctgctaaaacctttgcaggatgctgttcgcgacggagaccatatttacggcgtaatcaagggaagcgcgatgaatcaagacggaacaaccgccgggattacagcaccgaatccggcagctcagactgaggtcattgagacggcttggaaagacgcgggcattgcccctgaaacactgtctttcatcgaagcgcatggcaccggaacgaagctcggcgatccggttgaatttaacgggctttgtaaagcgtttgaaaagtacacggcaaaaaaacaattttgtgcgattggttctgttaaatcgaacatcggtcatttgtttgaagcggcaggcatcgtcgggctgatcaaatctgtcctcatgctgaatcacaagaaaaatccgccgttagctcactttaatgaacctaatccgctcattcattttcactcatcaccattttatgtgaatcaggaagctgcagcgttcacatccggtgatgagccgctgcgaggcggaatcagctcgttcggttttagcggaacgaacgctcatgtggtattggaagaatatatttctcaaagtgagtatgcacccgaggatgaacatgggccgcacctatttgttttatccgctcatactgaaaaatcactctatgaactcgcacagcagtaccggcaatatgtatcggatgacagccaagcttcattaaagtccatttgctatacagcaagtacgggcagggctcatttggatcatggcattgccatgattgtatccggtaaacaagaactatcggataagctgacccgcctgattcagggagacagaaaccttcccggtgtatacatcggttacaagaatatgaaggaaatgctgcctgctcataaagaagagctgaatcaacaagcagccgctctgattaagcagcgtttacgtacgcaagatgaacggatcacatggctgaatcgcgcagccgaattatttgtgcaaggagccgttatcgattggcgcgcgctttattccggtgaaactgtacaaaagacgccattgccactgtatccgtttgaacggagccgatgctgggctgaagctgaccaattgcgcttaaacgaggacgaaaagagaggagaagcggcattgaatatcaaccaatcgaaggcgcacattgaatccttcctgaaaactgtaatcagcaatgcttcggggatcagagcggaggaactcgatctgaatgctcattttatcgggctcggaatggattctatcatgctgtcacaggtcaaaaaagccatcgcggacgaatttggggcagacatcccgatggatcgtttttttgatacgatgaacaaccttcaaagtgtcatagattacttggctgagaccgttccatcgtcctttgcatccgctccccctcaagagaatgttccggcgcaggaaatacaggtcatttcagaagcgcagtctgaatcggatcgcagagaaggtcatcaagagcatatgctcgaaaaaataatctcttctcagaatcaattaattcaggataccttgcaagctcaattaaatagctttaatttgttgagaaacagcgggcatcattccgatgagaaagaatacgctaaggcgcaagagaaatcaattccttctgtcaagcaggggcctccggccgtcactgcagaaaagaaagcggctcaagaagcgaaaccctatgttcctttccagcctcagaacctgcatgatcagggacactataccgcacggcaaaaacaatacttagaagacttcatcaagaaatacgcagataaaacgaaaggttccaaacaatatacggacaatacccgatttgctcatgcaaacaaccgcaatttgtccagcttccgttcgtattggaaggaaatcgtatacccaattatcgccgaacgttctgacggttctaaaatgtgggatattgacggaaatgaatatatcgatatcaccatgggattcggggttaaccttttcgggcatcatccttcctttattacacaggttatcgatgattcaacccgttcatcattgcctccgctcggcccgatgtcagatgtcgccggtgaagttgccgaccggatccgcacatgtaccggagtggaaagggtcgctttctataattcaggaacagaggccgtcatggttgccctgcgtttggcgcgggcggcaacaggaagaaagaaagtcgtggcgttctccggatcttatcacggcacgtttgacggcgtattaggggttgccggcacaaaaggcggggctgcgtctgcgaatccgctggctccgggcatactgcagagctttatggatgatttgattattttacattacaacaatcccgattcgctggacgtgatccgcagtcttggtgatgaattggcagccgtactggtggaaccggtacaaagccgcagaccggatttgcagccgcaggcatttttgaaagaattgcgggcgatcacgcagcaatccggaacagctctgattatggatgaaattattaccggatttcggatcggtcttggcggcgcacaggaatggttcggcattcaggctgatttagtgacctacggaaaaatcatcggcggcggacagccgttaggggtagttgccggaaaagctgagttcatgaatgcgatcgacgggggtacctggcagtatggggacgattcctacccgcaagacgaggcgaaacgcacgtttgtggccggcaccttcaatactcacccgcttaccatgaggatgtcattagccgtccttcgccatttacaaaccgaaggagaacatctgtatgagcagcttaatcaaaaaacagcctacctggtcgatgagctgaatcgctgcttcgaacaagcgcaagtgcctatccgcatggttcgattcggttctttattccggtttgtctcatcgctagataatgacttgttcttttaccatctcaactataaaggggtctatgtgtgggaaggacgcaactgcttcttgtctgtggcgcataccgcggatgatatcgaaaatattattcaagcggtgaaagacacggtggaggatcttcgccgaggcggatttattccggaaggtccggattcccctgatggcggaggccgtaaaaagtccgggacgcgcgagctttcacctgaacaaaagcagttggttatggcatcccattacgggaatgaagcttccgcggctttaaaccagtccataatgctgaaagtgaagggcgaactgcagtatacaccattaaaacaagccgtccggcatatcgttgaccgtcatgaagctttacgtacggtgattcatcccgatgacgaggtacagcaagtgctggaacggatgaatatagaaatacctgtcattgattttaccggtcacccgcatgaacatcgggagccggaaatccaaaaatggctgacagaagatgccaagcggccgtttcatttccatgaacaagagcctttgtttagaatccatgtgcttacatcggctcacaatgaacatctgattgtgctcacgttccatcatatcattgccgatggatggtcaatcgccgtttttgttcaagaactggagagcaactacgcggcaatagtacaaggaataccgatttcaccgaaagaggcagatgtttcgtttcgccaatacttagactggcagcaggcacagattgacagcggccattatgaagaaggggtccgttattggcggcgtcatttttctgaaccgatacagcagccaattctgccaagcacagcttctgtccgttatccgaacgggtatgagggagaccggtgtaccgtcaggcttggacggccattgagcgaggctttaaggtcattaagcattcagatgaaaaatagcgtatttgtgacgatgctgggtgcatttcatctttttctgcaccggcttaccaaacagtcaggccttgtgatcggggtccccgcagcaggtcaatcgcatatgaaacagcatgatctgattggaaattgcgtcaatatgattccggtgaagaacacgtcttcttcagaaagcactttatccggttatcttggcagtatgaaagaaagcgtgaatcttgcaatgcggcaccaagccgtcccgatgacactggtggccagagagcttccgcacgatcaagtgccggatatgcgtattatctttaatttagacaggccttttcgaaagctgcatttcggaaaggcggaggcggagcccgttgcatacccggtaaaatgcaccctatacgatttatttctgaacataacagacgcgcatcaagaatatgttcttgatttcgactttaatacgaacgtcgtcagtccggaaatcatgaaaaagtggggagcgggttttacaaaattgctgcaaaaaatggttgagggagattcaatccctcttgacgccatgatgatgttttccgatgaagaacagcatgatttacaagcactttacgccgaacaccagaagcggatcacttcaataggaagcaatacggcaaattttactgaagcctatgaggcgccggtaaatgaaacggaacggcagctggcgcggatttgggaggaacttttcggccttgaacgggttggcagatcagatcgcttcctggctctggggggaaactcactccaggcaacgcttatgctttccaaagttcagaagacatttcatcaaaaggtttccattggacaatttttcaatcaccagactgttaaggaattagcacgtttcattcagaacgaaacgaaagtcgtgcacctcccaatgaaggctgccgagaaaaaagcgtattacccgacatcgccggcacagcaaagagtatatttcctgcaccaactggaaccggatcagctggcgcaaaatatgttcggccacatatcaataacagggaagtacgatgagcaagccctgatctcatctcttcaacaagtgatgcagcggcacgaagcgtttcgcacgtatttcgacattatagatggcgatatcgttcagaaacttgaaaacgaagttgattttaacgttcatgtccggacaatgagccgggatgaatttgatgcctattcagaccggtttgtaaaaccgttccgcctggaccaagctccgttagttcgtgcggagctgatcaagattgaaaacgagcaggccgaactgctcatcgatatgcatcatatcatttcggacggttattccgtcaacatccttacaaatgaattgctggctttatatcatcagaaaccattaccggacattgaatttgaatataaagatttcgcagaatggcaaaaccaacggctgaatgaggatgccatgaagcggcaggagacatattggctggaacaatttcaagacgaaattcccattctcgacctgccgacagacggttcaatagcggcagaacggtcttctgagggacagcgtgtgacatgctccttacagccggatgtcatccgttcgcttcaagatttggcgcaaaaggcggaaacgactctctatacggtgcttctggccgcctataatgtgctgcttcataaatatacgggacaagaagacattgtcgtaggcacgcctgcttcaggaagaaatcatccggatatcgaaaagatcatcggtattttcatacaaaccattggaatccggacgaagccgcacgccaatagaacgtttacggattatctggaagaagtaaagcggcagacgcttgacgctttcgaaaaccaagactatccattcgaccggcttgtggagaaattaaatgtacagcgggaaacaaccggaaagtctctgtttaatacgatgtttgtgtttcaaaacattgaatttcatgaaatccggcacaatgaatgtacatttaaagtgaaagaacgaaatccaggggtctctttatatgatttgatgctcacgatcgaagatgccggtcaacagatagagatgcattttgattataaaccaggacgattcacaaaagacaccattgaacagatcaccagacactataccgccattttaaacagccttgctgagcagccggagatgacattgtcttctgttcctatgctgtctgaaaccgaacggcatcaactgctgacggagtgtaatggcacaaagacgccgtatccgcataaggaaacggtatatcggtggtttgaaatgcaggcggaacagagtcccgatcatgaagccgttatttttggcaatgagcggtatacgtacagacagctcaatgaacgggcgaaccgattggcgcggacgttacggacaaaaggcgtacaagcggatcaattcgttgccatcatcagcccgcatcggatcgagctgattgtcggaattttggctgttctgaaagccggcggcgcatacgtgcccattgatcctgaatatccggaagatcggatccaatatatgctgagagattcaagagcggaggttgtgttgacacagcgcagcctgctggatcaattaccgtatgatggtgacattgtgcttttggatgaggaaaactcataccatgaggagcactcgaatcttgaatcggacagcgatgcgcatgatttggcctacatgatctatacgtcaggttcgacgggaaatccaaaaggtgtactcattgagcatcaggggctggctgattatatttggtgggcgaaagaggtttatgtaagaggtgagaaaaccaactttccattatactcttccatctctttcgatctgactgtgacctcgatatttacaccgctggttacgggaaataccatcattgtctttgacggcgaagacaaaagcgctgtgctttctgagattatgcgggactcaagaatagacatgatcaaattgaccccggcacatctgcacgtcatcaaggagatgaatatcgctggcggcaccgccatacggaaaatgattgtcggcggagaaaatttaagcacccgtctggccaaaagtgtcagcgagcagtttaaaggccggctggacattttcaatgaatacggaccgacggaagctgtcgtcggatgtatgatttatcacttcgacgcagaacgggacaagcgggaatttgtaccgatcggcactccggctgccaacacggatatttatgtggccgatgcaagcagaaacctggttccgatcggggtaatcggcgaaatatatatcagcggaccgggtgttgccagagggtattggaaccgcccggatttaacggaagagaaatttgttgaaaacccgtatgtcccgggagcgaaaatgtacaaatcaggggatttggctaagcgattgaaggacggaaatcttgtatatattgggcgcgttgatgaacaagtcaaaatcaggggacaccgaatcgagcttggtgaaattgaagcagcgatgcataacgcggaagcggtgcaaaaagccgcggtaacagtgaaagaagaagaagacggcttaaaacaattatgcgcgtattacgtaagcgacaagcctatagcggctgcgcagcttagggaacatttgtcatcccagcttccggactacatggttccgtcctattttgtccgtctggagcatatgccgttaacatccaacgggaaaataaaccgtaaggcgctgcctgcaccggaagcgagtctgcagcagacagctgaatatgttccgccgagtaatgagacggagtccaaactgacagatttatggaaggaagtgctcggaataagccatgcggggatcaaacataatttctttgatctcgggggcaactccatccgagcggcagccttagccgccagaattcacaaagagctggatgtgaatctgtctctcaaagacatattcaagtttcctaccattgaacaattggctgacaaggcgttacacatggacaaaaatcgatatgtaccgattccggctgcaaaggaaatgccatattatccggtttcttcagctcagaggcggatgtatttattaagtcacacagaaggcggcgagctgacttacaatatgacgggtgccatgaatgtggaagggacgatcgatcccgaacggttaaacgccgctttccgaaaattaatcgcgcgtcatgaagcgttgcgtaccagctttgatttatatgaaggcgagccggcacagcgtattcatcagaacgtcgactttacgatagaacggattcaagcaagcgaagaagaagcggaagaccgtgtgcttgatttcatcaaagcgtttgacttagccaagccgccgctgatgcgggccggactgattgaaattgaacctgcgcggcacttgcttgtggtggatatgcatcatatcatttctgacggcgtgtccgtcaatattctgatgaaagatttaagccgaatctacgaggggaacgaaccggacccgctctctattcaatataaagactttgcagtttggcagcaatcggacattcagaaacggaacatcaagagccaggaagcgtattggctggatcagtttcacggtgatattcctgtactggatattcctgcggattatgagcgacctgccatacgcgattacgaaggcgaatcatttgaatttcttatacccgaacacttgaaacagcgtttaagccaaatggaagaagacacaggagcaacactgtatatgattttattggcagcctatacgattcttttatccaaatacagcggacaagaagatattatcgtaggaacgccatctgccgggcggactcatctggatgtagagccggtcgtgggaatgttcgtcaatacgttagtcattcgcaatcacccggcgggccgtaaaacatttgatgcctacttaaatgaagtaaaagaaaacatgctgaacgcctataaaaatcaagactatccgttggaagaattaattcagcatctgcatcttccaaaagattcaagccgcaatcctttattcgatacgatgtttgtgctgcaaaatcttgatcatgctgaattgactttcgattcccttcaactcaagccgtatccatttcatcatccggttgccaaattcgatttgaccttgtcgattcaggcggaccgcgacaactatcacggactgtttgaatattcgaaaaaactgtttaagaaaagcagaatcgaggttttatcaaacgactacttacacatcctatcggcgattttggaacagccaagcattctaatcgaacatatcggattgagcggcagcaatgaggaagaagagaacgcgcttgattctattcaattgaacttttagggaaaagcattatttctttaaaatatataaaatgaggtgctccaatgtcggtatttaaaactcaagaaacgtactgggaaaacctgtttgatgaagaagacggtctaagcgcattcccttactttaaagcagcggataaagcgtcgttggtccgtaccggctaccaggaaaaatgcatctgccgttccttatctccggaagtatctcaaagaatcatgacaatggcgaatcattccgatatggcggcctatctgattttattggcgggtattgaatgcttgttatataaatatacggatcgaacgagcctgattcttggcattccaacggtatcgaagcaaaaagccggccagtcagccgttaacaacattgtcctcttaaaaaatacgctttcaaacgagagcacatttaaaaccgtattcgggcagctgaaagaagccgttaatgattctctgaaaaatcaaaacctgccgtttagaaaaatggcccggcatctaagcgtgcaatacaatgacgagcatatgcctttgattcataccgtcgtttcgcttaacgaaattcattccttgcaatgtaaagaagatactgcaaccgatacgctgtttcactttgatttggagaacaacgggattcatttgaagcttttttataacggcaatctgtacgatgagcgctatatcaatcaaattgtatcccatttggatcagctgctgtctgtgatcctgtttcagcctcaagccgcgatccatacggcagagatcttaccggaagcggaaaaacagaagctattgtttgattttaacgacaccgtcagagatttctccgggagcagaacagtctatcaattatttgaagagcaggcagaaagaacgcctgagaatgcggccgtcaaatttaaaaacgaccatttgacgtacagggaactgaatgagaaggcgagccgtttggcaagaacattgcgtaattgcggggttcaacccgatacgttagtcgccattctcgctgatcgttcattagagatgatcgtatccattatagctgtttggaaggcagggggcgcttatgtgcccctggatcctgaatatccaaaagagcggcttcaatatttgcttcatgatgcggatgcagacgttctccttgttcagcatcatttaaaaaacagtctcgcctttgacggcccggtgattgatttgaatgatgaaacatcataccatgccgattgctcattgttatcaccagtagcgggacacagccatttagcctatgtcatttatacgtcgggtacaacaggaaagccgaaaggggtcatggttgaacacggcggcattgtgaactcgcttcagtggaagaaggcgtttttcaggcattctccggcggatcgcgtacttgtcttgtacccgtatgtttttgatgcgttcattttaaatttcttcggcccgctcatctcaggagcaactttgcaccttttgcctaatgaagagaataaagaaactttcgccattcaaaatgccataaaacaagaaagaattacccatttttcaacttccccccgtcttctgaaaacgatgattgaacagatgaacagagaggatttcatccatgttcagcatgttgttgtaggcggtgagcagctggaaacagatacagttgagaagctgcattctctgcagcctcgcattcggatcaataatgaatacggaccgacagaaaacagcgtggtatctacatttcaccctgttcagtccgctgatgaacagatcacaatcggcagcccggtggccaaccatcaagcttatattttaggagcgcaccatcaaatccagccgatcggcgtaccgggagagctgtatgtcggaggagcgggagtggcccgcggctacctcaatcggcctgaattgacggaggaaaaatttgtggagcatctgcatgtccctggtcaaaagatgtataaaacgggggatctcgccagatggctgccggatggaagaatcgaatatttagggcggattgatcatcaagtgaaaattcgcggctaccggattgagatcggcgaggtagaggcagccatgttcaatctggaaaacgttcgtgaagccgcagtcgtcgcgcgggaagacgcagacggggccaaacaattgtatgcctattatgtcggcgagccttctttgaccgctgcgcagttcagagaagaattatcccgggaactgccgaattatatgattccctcccgctttatccctttggaacgcattccgctcacttccaatgggaagattgatatgaaagctttgcctgctgctgacgaaaatacgcgggcggaatacgaatacatagccccgcggaacacaatagaagaactgctggcgtccatctggcaagaagtattaggggcagaacgtataggaattctggataatttctttgattttggcggagattcgattaaatcaattcaggtgtcatccagattgtatcaagccggatacaaggttgatatgaagcatttgtttaaacacccctcgattgctgaacttagtcagtttgtagcaccggtcagcaggatggctgatcaaggagaagtgaatggcggaaccaagctgaccccgatacagcattggttttttgagcaaaaaatgccgcatgcacaccattacaatcaggccgtcatgttatattcggcggaaggctttaaagagggcccgcttcgccggacgatggaacggatcgcgtcgcatcacgatgccttgaggatgatttttgaaaaaacgccggacggatacgctccgcgaattacaggaacagatgaaagtgaactattccatctggaagtgatgaattataaaggggaaaccgatccggctcaagcgattgccgataaagcgaatgagattcaaagcagcatggtattagacaaagggccattgatgaagctcggtttgttccaatgtccggacggagatcatttgctgattgcaattcatcatttgctgattgacggtgtatcctggcgtattttgctcgaagattttgcaagcggttatgagcaggcagaacgcatacaaacgatccagctcccgcaaaaaacagactcgtttccattctgggccgatcaattgtccaaatatgcggcggaaaccgatatggaagaggagattgcgtattggaccgagctttcaagtataaagcctcagccattgcctaaggacactatcagcgaaggagcgttattaagagacagcgaagaagtgacgattcaatggacaaaagaggaaacggagcaattattaaaacaagcgaaccgcgcctacaacacggatatcaacgatctgctgctgacttcgttagggctggctgttcacaagtggacaggcacggaagacattgtcgtgaatttggaaggccacgggagagaaccgattattccggatgctgacatttcccgcacgataggatggttcacaagccagtaccctgtcgtcctgaggatggaagccggaaaaaacctgtcgcagcggatcaagatcgttaaagaagggctgcgccgtatccctgacaaaggaatgaattacagcatcatcaaatatatatccgggcatccggaagccgacagcctgcagctgaaaccggagatatcgtttaactatttgggacaatttgaccaagacctgaagcatcaggctttgcgcatctcgcctttttccacagggttatcaatgaacgaaaaccaagagagaacggccgtgcttgatttgaacggcatgattgccgaagggacattatcactgacactgagctacagcagcaaacaatacgaaagatctactatggctcaatttgcccgggggttgaaagaaagtctgcaagaagtcattgcacattgcgtaagccggcagcagacttctctcacaccaagtgacatcctgttaaaagacatctcaatcgacgaactggaacagcttttggagcagacgcgtgaattaggcgaagcggaaaatatttatccattaacgccgatgcagaagggcatgctgtttcacagcttatttgatccgaattcaggtgcttattttcagcaaacgatgtttgatctgcatggagatctggaaattgattcattttcaaaaagcttggacggcctatcgcaaaaatatgatattttccgcacgaatttttacagaggctggaaagatcagccgctccaaatcatattcaaaacgaaaaaaatcggttttcaattcaatgacttacgagagatgaaggaatcacaaaaagaagcgatgattcagaaatatgccagagaagataagatgcgggggttcgacttagaaaaaggcgcgttaatgcggttattcatccttcgtacggatgaaaaaacataccgttttatctggagtttccaccatattttgatggacggctggtgtctgccgctgattacaaaagaaattttcgagaattactttgctttgcttcagcaaaagcagcctgaacaatcgtcaattactccgtacagtcaatatattgaatggctcggccggcaagatgcgaaagaggccacggcttattgggatcagtacttggagggatatgaggagcaaaccggccttcctaaggatcaccatgcagcggaggacggacgatacgttcctgaaaaagtgacgtgtgacataagctctgatctcacttcgaaaatgaagcggacggcaggcaagcatcatgtcacgctgaacacgctgctgcagacggtatgggcggttttgctgcagaaatataaccgcagccgggacgttgtgtttggaagtgttgtatccggaagacccgctggaattccaaacgtggaaaccatgatcggcttattcattaacaccattcccgtccggttccggtgtgaagccgggacaacgtttgctgagcttatgaaagaggcgcaggaaagggctgtagcgtctcaacaatttgagacacacccgctgtacgatattcaagcgcgtacaacgcaaaagcaagatttaattacacatttaatgatattcgaaaattatccggttgatcagtatatggaaagtataggccgccaaaacggaacatccatcacgatttccaacgtacaaatggaagaacagaccaactacgattttaatttgaccgttataccgggcgacgagatgaacatctcttttgaatacaatgcaaatgtgtatgatcgggcaagcatagagcgggttcgggaacatttcatgcaaatcctgcatcaagtcgtgacagatgcggatatccgggtggatcaagcggaattgttaacggaaggcgaaagaagaacccttctgcagacgcttaacgacacggccgcgccgtttccgcagacgccggttcatcaattatttgaagagcaatcggagcgtacgcccgatcaagcagccgtcattgataaggacaggcagctcacgtacggagagctcaataagcgggccaaccgcctggcgcgaacgttaagagcgaaaggagtgcagacggatcagcctgtagccatcatcacaagaaacagcatcgaatcggtggtcggaatccttgccgttttaaaatcaggcggagcctatgtacctatagatccggaatatccgcaagaccgcatccggtatatgctggatgactcccaagccggaatcgttttaatgcagcgggacgtcaggaaacagcttgcctatgaaggcgtcacggttttacttgatgatgaaagttcttatcaccaagatggctctgaccttgctccgataagtgatgtgagccatttggcatatgtcatttatacgtcaggttccacaggccggccaaaaggcgtactaatcgagcacggaggcttgaccaattatatttggtgggcgaaagaagtttatgtaaaaggcgagaaagccaacttcccattgtattcgtcaatttcttttgatctgacggtgacttctattttcacgccgcttgtcacaggcaatgcaatcatcgtctatgacggagaggataaaacagctctgcttgaatcaattgtgcgggacccgagggtggatatcattaaattgaccccggcccatttgcaggtcttgaaagaaatgaacattgccgatcaaacggctgtccgaagaatgattgtgggcggggaaaacttaagcacccggttagcccgcagcattcatgaacagttcgaaggccggattgaaatatgcaatgagtacggaccgacggaaaccgttgtcggctgcatgatttaccgttatgatgccgcaaaggacaggcgggaatcagtaccgatcggaaccgctgcggcaaatacgagcatttacgttcttgatgagaatatgaaacccgcgccgatcggtgtcccgggagagatctatatcagcggcgccggtgtggcaagaggatatttgaaccgtcccgaattaacggcagagaaatttgtcgatgacccgtttgaacccggagcgaagatgtataagaccggagatttggcgaagtggctggcggacggaaacattgaatatgcgggcagaatagatgaacaagtgaaaatcagaggctatcgtatcgaattaggcgagatcgaggcggcactgcttcaagaagaagtgattaaggaagctgtcgttacagccagagaggacgtccacgggtttaaacaattgtgtgcatattacgtgagcggcgggcaaacaacggcagcccggctccggaaacaattgtctcaaacccttgcaagttatatggttccggcttattttatcgagcttgatgaaatgcctttaacttctaacggaaaaataaacaaaaaagggctgccggctccggatttcgaactgcaggacagagcagagtataaagctccccgaacaaaagctgaagaaatattagtttctgcctgggaatcggtattaggcgctgaaaacgtcagtattcttgataatttcttcgatcttggcggagattccattaaatccattcaagtatcctccagattaaatcagcaaggatacaaaatggaaatcaaagacttgtttcaatatgcaacaattgcagaattgagtccgcatatcaagcagaatctgcgtatagccgatcaaggtgaggtcaaaggaaaagtcagcctgactcctattcagcattggtttttcgaacaaacaacaacagatcagcattattacaatcaagccgtcatgctgcatgcgccggaaggttttcaggaaacgcagcttcgtcaaaccctgcaaaagcttgctgaacatcacgatgcgctccgcatgacgttccggactacggaaaatggctgtgaggcacagaatgaagaaatcacccaaagcggactgtaccgcttagaagtcatgaatctgaaagaagatcccgatccgggacgtacaattgaagccaaagctgatgagatacaaagcagtatgcatttaagtgatgggccgttaatgaaagccgggttgtttcaatgcgcagatggagatcatttgctcattgccatccatcatttgattatagacgggatttcatggcgcatactactggaagatatcgttagcggctacaagcaagccgagaacgggcgagtgattcaactgccgcaaaaaacagactctttccaattatgggctaagagactgtcagaatatgcgcaaagtgaaaccataaaacaagaacaggaatattggacaaaaatcgaacaaaccgaagtcaaaccgctgcctaaagattttcatgaaacccatacaactgcaaaagacagcgaaacagcaactgtggaatggacgaaagaggaaacggagctcttattaaaacaagcgaatcgcgcttatcacacggaaataaacgatttgcttttaacttctctgggtctttccatatcgcattggtcaggactggaacaaattccgattcatttagagggacacggccgagaacagattatacaagatatagatatctcccgcacggtcgggtggtttacaagtctgtatccggttgtgctgcacgcgcagccgggcaaagaaatctctgattatatcaagacgaccaaagaaggattgcgccaaattccgtataaagggatcggatatggaatagcaaggtacttaagcggcggaatgccatcgaaactcaatcctgagatcagctttaactacctgggacagtttgaccaagatttacagcagcatggggttcagttatcttcttattcttgcggttcagactcaagcggaaatcaagaaagaccgtatgtattgaatataaacggaatgatcaccgagggccggctgaagcttacgatcagctacagcagcaaacagtacgcaaaagaaacgatcatgcggttatcggaaacgattcaaagccgcctgcggacaatcattacgcattgcgttcataaagaacaatcggaactgacgccaagcgatattttgttaaaaggcatatccattgacgaattggatcagctcctcattcaactgccgcatgcaggtgaggttgaaaacgtgtatccgctcactccgatgcagaaaggaatgctctttcacagcctgctggacgaggcctcaagttcttattttgaacaagcatcgttcgatttgcagggagagttaaagattgattggtttaaagcaagccttgaacgattatttgaaacatacgccgtgctcagaacccgtttttacagcggctggaacgatactcctttacaaattgtctataaaacgcaaacaccgcaaattcattttgcagatttgcgtgatatagaggagcacctgagagaggatacaatcgcagcctatcaaagagaagacaaggcaaaaggatttgacttggctcgggatccgctgatgcgcatagcgattttccgtatggaagaccgcaaatatcatttgatttggagcttccatcatattgtgatggatggctggtgcctgtctcttatcacgaaggaagtgtttgatcattatagcgccttacaggaaggcagggaaccagaaccgccatcggcagttccttacagcgactatatcgagtggcttgaccgccaagatcagggagcggcaaagcggtactggagcgggtatcttgaaggatataaaggtgaaaccacgcttcttcataaaatagcgcagcatgaacaaaaagaatacgcttatgccaatgcgatctgccgatttgatcacgaacagacaaaacaattacagcagatcgcaaatcagcatcaggttacgttaaatacgttgatccaaacgttatgggggattttgttacagaaatacagcgggtccgcagacgttgtcttcggcagtgtcgtgtcgggaaggccggcggaaattcctgatgtggaacagatgatcggcctgttcatcaataccattccggttcgcatccgctgcgatgaggacagcacttttgctgatacgatgcaaatggttcaacaaaacgcgctggcttcccaatcgtacgatacctatcctttatacgaaattcaggcccaaacggaacaaaagcaaaacttaattgatcatatcatgatctttgaaaattatccgatagggcagcaagttgaagagggccatgatgctgcggatttaaatatcgtgaatttccatatagaagaacacacccattacgattttaatgtagttgtcatccctggcgaacaactcaccgttcattttagttttaaccgaaatgaatatgaacaatcagaggcagagcggattcgcggacattttgaacagcttatgcagcaagtattgcagctgccgtctgtcaaagtagaagaaatggaacttctgacgcagcaagaaaaagaacagctgcacagccgttttcagtctaacgaaatgcattacccacgtgaacaaacgattcatcagctgttcgaggaacaagcactccggacgccggaccatgaggcggttatattcgaggagcagcgtatgacttaccttgagttaaatgaacgggccaatcaactagcacgcactttacgagctgaaggcctacaggccgaccagcttgttgcgatcatggctgagcgttctctagaaatgatggtcgggatttatgcaatcctgaaagcgggaggcgcttatgtgccaatcgacccggattacccggaggaacgcatacgctacatccttgaagattcaggagcgaccctgctgctgtcacagcgtcacgtgaaagaacgggttgcttttgcaggaacggtcatcgatctcgatgatacttccgtttacgatgatgacgtttctaacttggagccgctgtccggtgcgggcgatagggcatatgtaatctacacgtccggatcgaccggcaagcccaagggggttatggttgaacatcgtccggttataaaccggttgatgtggatgcaaaaggcttatccgatcggcagcggcgatacgattttacaaaagacagcgatcaccttcgacgtctcggtatgggagctgttctggtgggctttgaccggtgcgaaggtgtgcctgcttccgctcggcggagagaaagaccctgaagtgatttggaacacaatagaagagcaaagtatcacgacaatgcatttcgtcccggcgatgctgcacgccttcctgaagtttgcggaaacacagacggcgagcggacagacaagcaagctgcgtacgttgcggcaagtgtttgcaagcggtgaggcattaatgccggcacatacggcaagatttcatcgccttattacgcctgtgaacggcgcccaactgatcaacctgtacggcccgacggaagcaacggtcgatgtgtcgtacttcaactgcgaagcaaaccaagcgtatgcatcagtaccgatcggcaagccgatctcgaatatacagctgtatatgatggcaccgggatcaatgcgtctacagccagtcggagtaccgggagagctttgtatcgcaggcgacgggctggcgagggggtacctgaaccgtccggagctgactgcggagaagttcgtggatcatccgttcgagcccggcaaacggatgtaccggacgggagatctggcgagatggctgccggacggtaacatcgaatatttgggccggatcgatcatcaggtgaaaattcgaggatacaggatcgaactcggcgaggtggaagctcagctcttaaagatagaatcggtacaggaagcagtagtcaccgctcttgaagacggagccggagaaaagcagctatgcgcatacttttcagcgaacaccgagctgatggtaagcgagctgcgaatagcgctgtcgcaggaactgccggggtatatgatcccgtcgtactttatccaactggagcgtttgccgttaacggcaaacggaaaaatcgaccgcaaagcattaccagcaccagaagaaggcgtgcaaacagggatcgaatatgttgctccccgtacagcggcggaagcgcagctggcgcatatctggcaagaggtgcttggacttccgcgtatcggcgtgaaagacaatttcttcgacatcggcggtcactcgctgcgggcaacgacgctgatggcgaagctgcacaaagagatgggggtcagcctgccgctgcgggaagtgttccgatcgccaacaattgaagaaatggcagaaacgattaccggaatgaaacacacagcatatacatctatcccgaccgttgaagcaaaagaatactatgccgtctcctcggcgcagaaacggctgtacattttgaatcagctgaaaggcggagagctgagctacaacatgccgagtgtcatgagagccgatggagctttggatcgggaacttgtcgagaaggcgatccgcaagctgattcagcgccatgaaacgctgcgtaccggctttgaactgatagacggagaaccggtgcagcggatctatgacgacgtccaatttgcagtggaattcactcaagcgaaagaagaacaggcggaagccctcgttcatggttttgtgcgtgcatttgacttggagaaagcaccgctgctgcgggtaggattgatcgagcttgcaaaagaccgccatttgctgctgtttgacatgcatcatatcatttccgatggcgtatctatcaagaatttgattgaagagttcgtttcattatatgaaggaaaagaattcccgccattgcgggttcagtataaagattatgcggcgtggcagctgtcggatatgcaaagcgaacggatgaagaaacaggaagcgtactggctggatgtgttcagcggagaggttccggtgctggatatgccaaccgactacggaagaccggctgcgcggagctttgatggaggacaaatcgagtttgtcatcggaccggagttgacggaacagctgaaaggcttggcgctgaagagcgaaagcacgctgtacatggtcctgctggctgcttatacgaccatgcttgccaaatacagcgggcaagaagacatcgtagtaggcagcccgattgccggaagaacccattcggatttggaaagcttaatcggcatgtttgtgggcacactcgcgatacgaacgaatccggtcggggaaaaaacattccgagaatacgtgcaggaagtcaaagagcatacattaaaagcgtacgaaaaccaggagtatccattcgacgaactggtggacaagctgaatgtgtcccgggatttcagccgccatccgctatttgacacgatgttcatatggcaaaacacagaacagggagaattgagcctcgatgatgtgcgttttaccccttatccggacaaccatgcgatggcgaagttcgacctgacgttccaagcggcagaaaatgaagacggaattacaggtatgatcagttacgcggcagcgctgtacaagcaggaaactgcggaacgcatggcaaagcactttatccaattgatcgaggcgattgcgaatgatccgcaggcgccgctttcatcgctggagatgatcaccgcgcaggagaaagagcagattgtggaaagatggggtcaaccggcgatagactgcccaagggacaaaacaattcaccaattgttcgaggagcaggcggagcgcacgccggaacatacggccgcagtttacgagaaaagccgattcacataccgtgagctgaatgagcgggccaaccgcctggcgcggattttaagaagcgaaggcgtgcagcctgaccagcctgtgggtattctggcagaacgttctctggaaatgatcgtggggattatggcgatcctgaaagccgggggcgcgtatgtgccgatggatccggacagtccgcaggaacgcctccgctatattctggaggattcaggagcaaaggttctgctggcacagccccatttacaagatcgtgtatcctttgccggagagattttactgctgaatgacgaacgaatgaacagcggggatggctcgaatctggtgacggcagccggaccggatcacttggcgtatgtgatttacacatcaggcacaaccggcaagccaaaaggcacgctgatcgagcatcgccaggtccttcatttgatggaggggatccgcggacaagtgtacggtgcttatgattcgggattgcgtgtgtctctgttggcaccgtactatttcgacgcatcggtcaagcaaattttcgcggcactgttagggggacatgcactgtatatcgtccctaaagcatcagtatcagacggttatgccttgtcaaactattatcgcacccaccgcattgacgtaacagacggaacaccgtcacatttgcaattgcttatcgctgcagacagccttcatggggtaacgatccggcacatgcttattggaggagaggcgctcccgcaggcgacggtggcgcaattgcttgaattgttcgcttcgaacgggtcatcaatgccgctcataaccaatgtatacggtccgacggaaacctgcgtggatgcatcggtctttcacatcgtaccggagacattggcatccgctgacgacggcggttacgtgccgatcggcaaaccgctgggcaacaaccgtgtgtatattgttgattcccatgatcggatgctgcctataggtgtaaaaggtgagctgtgcatcgccggagacggagtaggacgggggtatctgaacttgcctgaattaacgggcgaaaagtttgtggccgatccgtttgtaatcggagagcggatgtataaaacaggcgaccttgcccgttacctgccggatggaaacattgaatatgccggaagaaaggatcaccaggtcaaaattcgcggttaccggatcgaacttggcgaggtggaagccgctcttctcaacatcgagcatgtacaagaagcggtgatcgtggccagagaaaatgcagaggggcaaagcgatttgtatgcctattttacaggggagaagtcactgccgatcaatcagcttaaagaaaaactctccgatcaaataccaggctatatggttccttcatacttgatgcaactggagcaaatgccgttaacctccaatggaaaagtgaatcgcagcgcgttaccgctgcctgaagcaggcttgcagaccgggattgactatgttgctccaaggacaagaccggaagagcagctggttcacatctggaaagaagtattgaaggtagaacaagtcggcgtgaaagataactttttcgatctcggcgggcattcgttacgggggatgacgctcgttaccaagatccataagcaattcgacaaaagcatttcattgagagaagtgtttcaatacccgacgattgaagaaatggcgagggtcattgcaggcgcggaaaccagcggtccggatgaaatccctgttgcagaagccaaagatgtttatcctgtatcttctgtgcaaaagatggtttacctgtctacacaaattgaaggcggagaactaagttacaacatgccggggattttgacattggaaggcaggatcgacatgaatcgtttacaatctgcgttccaaagtctgatccagcgccatgaatcgctacgaaccggatttgaaatggtccgcggagagctggtgcaggtgatcaagccgcaggcggatttctctatagaaaggtacaaagcagctgatgaagaggtcgaggagctgttccgcaatttcgtgcggcctttcgatctcagtcaggctccattgcttcgggccggactcatcgaattagaacaggacagacatgttttcatgtttgacatgcatcatatcgtttcagacggcgcttctatgaatatttttgttgaagaactgattcaattgtatgacggcaaagaattaaccccgctccggattcaatacaaagattacactgtatggcagcagcaggcggagcagagggaacgaatcaaaaggcaggagagctattggctgaatgtatttcatgaggaactcccgccatttgagctgccgaaagattttgccagaccgcgaattcgaagctttgaaggcaagcgatacaatttcgccctcgatgagactgtgatccaggggataaaacagatggaagaattgaccggatcgaccgcttacatgatcttgctgtcagcctataacatactgctggccaaatacagcggtcaggaagatatcgtcgtcggtacgcctattgcgggaagaatgcatgaagatttacagcatattatcgggatgtttgtgaatacgctggccatccgtacggccccggctggagaaaaaacctttatggactatgtaacggaaacaaaagaaacgatgctgaaagcttatgaaaatcaagagtacccttttgaagaattagtcgagaaactgggagtgaaacgggacttaagccgtaatccgttattcgatacgatgtttgttctgcaaaatacggaacaaacggatatcgaattggactctctcgcggtcagaccatatgaacaaacgaatacggcggccaaatttgatttgcagctgaccttcgtgatgaatccgcacgagattcaaggaagctttgagtattgcacgaagctgtttaaacagaaaaccatcgctacgctgagcaaggattacgccatgattctgtcggcgatcataaaagacccatcgattcctttaaaagaaattcaattaagtgagaaagtaaacaaaagtgaacactttgcaagcgaaatcgaattgaatttctaaaaacggccgaaaccggctgtccccggcatgatgtttttacggggacagcggtcagccggctaaaacttactggagggatattaatgtcagaatttaagcaacaggagttgttctggagcagcatgttcgatgcggaagatcgtcccagtgcaatcccttcgtttcaaatgtcggactcagcaatagagcatgatgcgtcgagtgcacccaaccgtattcacagttcattgagccccgatgtatccctgcgcatcatgaagatgacgaataaatcgccaatggccgtttatatggttctcctggttggaatcgagtgtcttttgtacaaatatacgggggaagagggcgttattgtaggtgtaccgacctttgaagacgaaaccgatgaagaccttcgtttagaccaagtcatgttaatcaaacaaaacataaatgcggacagcacgtttaaatccatttttaatgaattcaagcatacgctgaacggagccatcttacatcagcacgttcctttcgataaaatggccggtccattaaatctgaactacgattcaaatcatttgccaatgatccacacgattgtatcactagatcagcttcaccccattcgttttagagaaacggctgcttctgatacgttatttcagttttccatagaaaatgattcgattcatttaaagttaacttataatgaacaagcttatgatcgccagtatatgatgcaagtgatcgaacatgtaaaccggattttttcgattttgttattccaacccgaccttatgatccgccagcttaatattctgtcagactcagagacaaatcaactcatcgcctataatcaaacggctgcagagtatccaagagaaaaaacgattcatcaatttttggaggaacaagcggaacgtacccctgatcaaacggctgttgtctacgaggatagccgtctgacgtaccgtgaattgaatgaaagggcgaatcaactcgctcggacactgcaatctgagggcgtacagccggatcagccggtcgggattatggccgaacgcgccctggatatgattgtagggatcttcgggatcttgaaagccggcggggcgtatgtaccgattgacccgggctatcccgaggaacgggttcgatacatattggaggattcggatacgaagttgttactcgtgcagaatcaatcgcaagagagagtaccttttacgggaaaagtgctggatatgaaagatccgcaaaacttttgtgaagacgggtcgaatgtagagccggctgctggtccggatcatctggcctatgttatttatacatcgggttcaacgggcaagccgaaaggggttatggttgagcatcggtcggtcatcaatcggctggtgtggatgcaggaaaaataccctctcgatgagcgggatgcgattctgcaaaaaactgcgatcacctttgatgtatcagtgtgggaactgttctggtggacgatatcaggttccagattggttctgttgccaaacggaggagaaaagaatcccgagctgattttagatacaattgcacaaaaaggtgtcagcacaatgcattttgtaccggcgatgctgcatgccttcctggaatccatggatcagaagccaagcgggatgttgaaacaaaaattagcgtcattaagacatgtgtttgcaagcggtgaggctttgaagcctgtacatgtcgcaggctttaaacacatcatcacatcggtgagccaggctcaaatcatcaacttgtacggaccgactgaggcaacaattgatgtatcatactttgattgccagacggaagaaacatatgcatcgattccgataggcaaaccgatttccaacattcaattgtatatattacatgctgatttggaacatatgcagccgatcggtgtggcgggagaactgtgcattgcgggcgatgggcttgcaaggggctacttgaatcgtcccgaactgacggccgagaagtttgtaaaccatccgattgcatcaggagaacggatataccggacgggagacttggcaagatggctgcctgacggcaatatcgagtatttgggccggattgatcaccaggtgaaaatccgcggttaccgcattgaaatcggcgaagtcgaaggcgctttttttcagctgccggcgatcaaagaagccatcgttatcgcccgggaaatcgagggggaaacatccttgtgcgcctattataccgcacaacatgctttaactgcaggcgagctccgtgaagagctgtcccgccagcttccatcctatatgatacctgcgtatttcgttcagctggaagagatgccgcttactttcaacgggaaaatagaccgtaaatcccttccttctccaagagagaatcttacaggcatgaactatgaagctcctcgaacagaactggaaaaaatactggccgcggtgtgggagtcggtcttaggcttagaacgggtcggaatctcagatcattttttcgaattggggggcgattccattaagtcgattcaagtgtcctcaagattataccaagccgggtataagtttgaaatcaaacacttgtttaaatacccaacgatctctgagcttgttccatacgtagagccggtaacccgaatcgcagaacaaggggaaattaaaggccgggcgctgctgacaccgattcagcattggttttttgaccagaaatacccggaattacaccattacaatcaagcggttatgctttattggaaagagggactggatgaatcaaagcttcgggacgtcatgaagaagatcacagagcatcacgatgctttgcgcatggtctatgttccgacagaagatggatatgaagcccgaaatcgcgggatcgatgaaggtgatctgttcagccttgaagtgatctcactacgcgaagaaaaaaatgtgtcccagacgatagaaaccatttccaatgagattcagcaatccattcatttagccgaaggaccgctcatgaaactgggattgttccggtgtcaagagggagatcatttgctgattgcggttcatcatctggtcatcgacggcgtatcgtggaggattttacttgaggatatagcagcagcttatgagcagcttcaaaacggcgaagcgatccggcttccgaagaaaacggactcttacctgttatgggctgaacagttgaatcgttatgcagaaagtcaggaattcgaagcggaaaatcaatactggttcagacagaaacataatccgcaacttacattgccaaaggacaatgaacaggagaccggtctggccaaagacaaggaaacggtcatcgttcaatggaccgttgaggaaaccgaacgtttattaaaaaacgctcaccgggcttattcgaccgatatgaacgatttattactgaccggtctgggaactgctattcatcgttggaccggatatgaagacattctcattgatcttgaaggacacggcagagagtctatcattccggatctcgatatttcgcgtacggtgggatggttcacaagtctatatccggtttcgcttcaaatcaaagctgatcaggatatcccgcagcggattaaaacagtgaaagaaaatttgcgtcagatcccccaaaaaggaataggttacggcctgatcaaatatttgtccgatcacccgaaggcacatgaatggaccggacatccggaaatacgtttcaattatttgggtcaatttgatcaagatgtccggaacggcaggatggagatatccccttactcaagcgggaaaacagccagtgacaatcgtcccatgacctatacacttgatatcaacggcatgatttcagacggccgattgtcgctggccatcagctattgcggtaaacaatatcaaagagaaacaatggaagcctgtgccgatctcttaaaaagcagcctgcagcaagtcatcgcacattgtgatgctcaagatcaaattcacctgacgccaagcgatatttcgttaaaaggtataacgatcggtgaattagatcaatttgtgcagcaaacgagtcatctcggtgacattgaaaatatatacccattaaccccgatgcagaaaggaatgttgttccacagcttgatcgattcggcttccgaagcttactttgaacaagccgcttttgatctgaaaggtttcttggatatcgatgcattcaggatgagtttggcgcatctggccgaaaaatatgacattcttcggactcttttttatacagaatggaaagatcagcctttgcagattgtattccggcaaaagccgattgaaacggccgttgaagatattcgcagcatgaacagtcatcagcgcagcgagtttattgccgattttgcaagaagagataaggcgcggggattcaatctcacccgggatgctttaatgcgcgtatcgatcctgcggacagaagaagaccaagcgcgattgatatggagctttcatcatattttaatggatggctggtgtttgcctcttgttacgaaagaagtgtttgaaacctattatgcgatactcgagcaaaggcagccgaagcggggagccgtcactccatacagccgatatatcgaatggctggatcaacaagatcacaagcaggcgtcagcctattggcgtaactatttagaaggttatgaagggcagactgttttgttacaagaacaaacttccgaccgggcgaaaggatacgaaaaaggtgagcatgagtttcgtttaggaaagcggctcacagacgaaatcaaacgggccgcaagccgccagcaagtcaccgtcaatacatggatacaaaccgcatggggcttattgctgcaaagatacaacgggagtcaggatgtcgtcttcggcactgtcgtatccggcagaccggcagaaattccgggaattgaaaccatggtcggtttatttatcaataccattcccgtacgtattcatacgcagcctgaaatgacagctgcacaagtattgaaaatgaaccaggagcgggcactggcttctcaaaaatatgatacatttccgttgtatgacattcaggctcaaactgagcaaaagcagcagttgatcaatcatattatggtatttgaaaattacccggttgagaaacaaatagaacatatgaagcaggatgacaacgcattagacattctcgattttcatatggaagaacacactcattacgactttacttttatagtgatgccggatggagaaattgacattcgttttgtatacaatcgcgatgtttatgaccaagcaagcgtcgaacggatgcagacgcatttcatgcaaatcatgaagcaaatggcggacgatcaggaaattcgcgttcaagaccttgatatcgtaacagcggatgagcgatcgctcctgatagataagttcaacgatacggcggctgagtatccaaaggaaaagacgattcatcaattgtttgaagaacaagcggagcgaacgccggagcaagcggcgattgtttttgaagataagaagctgacgtatcgggtagtaaatgaacgcgccaatcagctggcccgaaccttggttgccaaaggacttcaggccgaggagcttgtcggcattatggcggaacgttcaccggagatggtgataggcatccttgctattttgaaagccgggggcgtttacgtaccgatcgatccggattatccgaaagaacgcatccattatatgcttgaggattctaacgtctctatcttattattgcaacatcatcttctggaaggtaccgattatcaaagtcatactatcttccttgacgatccgtcatcatacggcgccgaagcatctaatctcaatctgaacgtgatgccaaatcaattagcctacattatttatacatcaggaacaacggggaatccgaaaggcacgctcattgaacataaaaacgtggttcgtctgttatttaataataaaaatgtttttgattttaatgcatcggacacatggactttgtttcattccttctgctttgacttttcagtatgggaaatgtacggagcgctgctgtatgggggcaaattagtgattgttccgaaacaaatagcaaaaaacccggaaaggtatttgcaattgttaaaatcggaagctgtgaccattttaaatcaaacgccaagttatttctatcaactgatgcaggaagagagagcagatcccgaatccaatttaaacatccgaaaaatcatatttggcggagaggcgttaaatccatccttcttgaaagactggaagcttaaatatcctttaacacaattaatcaatatgtacggcatcaccgaaactaccgttcatgtcacatataaagaaatcacggaacgggaaatcgacgagggcagaagcaacatcggacaacctattcctactctgcaagcgtatattttggacgaatatcagcgcattcaggtaatgggcataccgggcgaactctatgtggcaggagagggactggccagaggatatttgaaccgcccggaattaacggctgagaaatttgttgaacacccgtttgccgcaggcgaaaaaatgtacaaaacgggagatgtcgcccggtggctgcctgacggcaatatcgagtatttgggaagaattgatcatcaggtgaaaatccgaggctaccggattgaaattggcgaggtcgaagcggctttattgcaatcggaatctgtcaaagaagcggtcgtcatcgcaattgaagaagagggctcaaagcagctgtgcgcctacttgtcaggagacgattcattaaatacggcgcagctgaagcatcatttactgaacaaactgcccgcttatatgataccggcttactttgtacaaatggagaagatgccgataaccgcaaatggaaaaatcgatcgaaaagctttgccggctcctgagggaaataggctcaccggaaccgaatacgaagcgcccggaacgttgattgaaaagcagctggccgagatatggaagaacattttagctctcagcgacccgggaattaaagataacttctttgacgttggcggccattcgctcaaagtattgcaagtaattcatcaaatcaacgaccgtatgggaatcaaaatgcattatcaagccgtatacgattttcctaccatcgaaacaatggcacgcgccattcaagcggcagttttcgagtccaagacggataacgtattcgtcaagatgaatcagaacggtttaatccctgtgttctgtttcccgcctttaatcggatacgggctggtctataatgaaatggcgaaaagacttgacggccgctgcaccgtctatgccgctgatttcctagaagagccgtcttacgaaaaagagatcgttgaccggtatgcagaaagcatgataggcattcaggaacaagggccctttgttttacttggttactcctcggggtcgaatttggcttttgaggttaccaaagccttagagaagcgcggacgcatcgtatcggacattatgatgcttgattctaaaagagccgtttcggtgaattatttttcggaagaggaaaccgaagagatcattcatcggaatctggatatcattccggattattatagagaattattaaccattccttcgattaaggataaaatcagaagctatctcacatatcacaataaactgatcaattccggcgcggtgaacgccaacattcatcattttctatgcggcgagttgaccgatagaggatggaagcaatcaaccgcacagcattaccttgagtacaaattaaaaggagaccatgtgacgatctttgaccctcacaatatcgaagaaaatacggatacaattcgatctattattaaaaggattgaagagcggcatcatcacggacttgttcttgaagaacaactgtcaatgggatcgtttgctggcgacacgaagtttgacaaaatgtaaatgattcagggcaaaatgccgctgactgcaaccggcggcatttttcataaaagagggtcagatatttgcaacgttttcactctaaaaatcattcattttacgcattcttcatgacctgttgttatcatattttttaaaaacctaatatgcggaaacaggaggatgttaagcagatgaaaaagtgcagcgtatgtttattgattcttgctttattattgagctgtttacctggggaatatgcgaatgcggtaagcactccaattgcaaaacatgttgggaattcaaatccgcttatcgaccatcatctgggcgcagatccgtttgcgctgacctataacggaagagtctacatctatatgtcaagcgatgactatgaatataatagcgacggcacgattaaggataattcatttgccaatttgaataaaatatccgtcatatcttcagcggatatggtgaactggacagatcacggaacgattcccgcagcgggtgccaatggggcgaatggcggccgggggattgccaaatgggcaggagcatcatgggccccgtcagccgcggtgaaaaagatcaatggtaaggataaatttttcctttatttcgcaaacggcggcggaggtatcggggttctcaccgcagacagcccgaccggcccatggacagatcccatcggaaaagctctggtaacgccaaatacgccaggaatgtccggtgttgtatggctttttgatcctgcagtattcgtagatgatgacggtaccggttacctatatgccggcggaggcgttccgggcggttcaaatccaacgcaggggcaatgggccaatcctaaaacagcaagagtcatgaaattaggtcctgatatgaccagtgttgccggaagtgcgtctacgattgatgcgccttttatgtttgaagattcgggaatgcataagtataacggaaaatattactattcctattgtatcaatttcgggggcgcgcacccggccgataaacctccaggtgagatcggctatatgaccagctcaagtcctatggattctttttcgtatagagggcactttctgaaaaatccgggagcatttttcggaggcggcgggaacaatcatcatgctgttttcaattttaaaaacgagtggtatgtggtgtatcatactcaaactgtcagctccgctctttacggggccggcaaaggttaccgttctccccatattaataagcttgtgcataatccagatggctccctgcaagaggtagcggcaaattttgcaggtgtcaaacagctatccaatttgaatccatatcaccgcgtagaagcggaaacgtttgcctggaacggacggattttgacagaggcatcctcagcacccggcggcccggtcaataatcaacatgtcacaaacattcataacggagactggattgctgttggaaatgcagatttcgggtcaggcggtgccaggacgttcaaagcaaatgtagcgtccgctcttggcgggaaaatagaagtgcggctagatactgcaaacggtaagcttgtcggaaccttgaatgtcccttccacaggcggaacgcaatcttggagagaaatagaaactgcggtaagcggcgcatccggtgttcacaacgtattctttgtatttaccggaactggtacaggaaacttgtttaatttcgattactggcagtttacacaaagataagcaaagggagacaaaggtacgttttctaagtccataaacgacatatgaaggagaggaaaaaatgatatcgagcgtaaaaaaaacaatttgtgtattattggtatgtttcacaatgctgtccgtcatgctcttaggaccgggagttactgaagtttcagcagcaagtgatgcaacagttaatatatctgcagaaagacaagtgattcgcggttttggaggaatgaaccacccggcttggattggagacttgactgcggctcaacgggagaccgcttttggcaatggacagaatcagttaggtttttcggtcttaagaattcatgtagatgaaaatagaaataattggtacaaggaagtggagactgcaaagagtgcgatcaaacatggagcaatcgtttttgcttccccttggaatccgccaaacgatatggttgagactttcaatcataatggtgacacaacagctaagcggctgagatacgataagtacgccgcatacgcgcagcatcttaacgatttcgttaatttcatgaagagtaatggtgtgaatctgtatgcgatttctatgcaaaacgagcctgattacgctcacgaatggacatggtggacgccccaagaaatcctgcgtttcatgagagagaatgccggttccattaatgcccgcgtgattgcgccggaatcatttcaatacctgaaaaatatatcggaccccattttaaacgatccgcaggcgcttaggaatatggatatcctcggaacccacctgtacggcactcaggtcagtcagtttccttatcctcttttcaaacaaaaaggaggagggaaagagctatggatgacggaggtatactatccgaatagtgacaacaattcagcggatcgctggcctgaggctttaggtgtttcagagcatattcatcattcaatggtagagggagattttcaagcttatgtgtggtggtacatccgcagatcatacggccctatgaaagaagatgggatgatcagcaaacgcggatacaatatggctcatttctcaaaatttgtgcgcccaggctatgtaaggattgatgcaacgaaaaatcctgaaccgaatgtttacgtgtcagcctataaaggagacaataaagtcgtgattgttgccattaataaaaataacacaggggtcaaccaaaacttcgtgttgcagaatggaactgcttcgcaagtatccagatggatcacgagcagcagcagcaatcttcaacctggaacggatctcaaagtaacggacaatcatttttgggcccatcttccggctcaaagcgtgacaacatttgttgtaaagcgttaaaggcatcagcatcgcaataagccaattttcttactcaaaaaagaaaattggcttattttctgtgggagagaagtgttgatttttttaacgatacacagacattgggtataataatgacaatgacttcaaggagtgatcaatatatgtcacggcttcacagcaaagtattaatcatagacgacgaaaaagaaattttggaactgatcaaaaccgtattaataagagaaggcattgatcgcgtagtgacagcttcgactgcccgtgacggattggctcaatttcatcaagaaaatcccgatctggtgatattggatatcatgctgccagacggtgaaggctatgatatctgcaagcaaataagagacatttcacacgttcctattatctttttgtctgcaaagggggaggaaacggataaaattgtaggacttgccatcggcggggacgactacattacaaaacccttcagccctaaggaagttgcatatcgagtcaaagcgcagctgagacgggtctcttacttacagccttctcaaaccggaaccgtgataaaaaaaggaccatttgaattaaaccaacaacaagccgagctcaccaaaaatgaagcggctattgagttaacacctaaagaacttatgcttatgacctattttctgcagcatcccaatcgggtgatcagtaaagaaacactttatcaagctgtatggggagaagatttcttcggttctgacaatacggtgatggttcatatacgcaggctccgtgagaaaatagaaactgtcccatcaaaaccagactttctcgtcactgtgaaagggttaggctacaaatttgttgtaaaggatgcgtaaggatgaattggcgattaacaggcagatacatggtatctgtcatcatagtgaccatcattacagtcttcattaatttatttatttttatgttttggctcgttttccaggcgaacagccaacatgacgaagaaagtacaccggaaactttcacaagatcattccgacaatatgtcacgttatcgaacaatggtatcacagtaaacaaagagggccaaaaagctttaaaagagcagaatgcatggattcaaatattagatgaaaacggacaggatgtttatcatgatagagaacctaaaggactgaagaaaaaatatacgcctattgaaattgtaaatttacataaatataaggatgaacaattattatcaaccatttacgctggcgggaaaaaagtaaatggcaaggagtacagttactttatagggtttaaaaatccctctctcggaaaatttgtcctctcatatgataccaaggaatttgtgacgaagttcaatgcaggaaccatcatattattatcaatagatgcattgatcgcgttactcattggctatctattcagccggcagctcacaaaaccgctcggccgtgtcattcaaggaattcagcggttagctaatggagattatacgatcaaaatgaaatccaaaggcatttataaagatgtcttctataatgtcaatcatttatcggaacaactatcttcaagcacaaaagaaaaagataaattagagcaaatgcgtgaagagtggatcagtcatatttctcatgacattaaaacaccattagcatctattcaaggctatgcagaaatcatccaagatccaaattaccatctcacagccgaacaggtcagagagtacgcccagatcattgagagtaaatccctctatatgaaagatgtgatggaagatttaaatttaacgacaaggctgaaaaacaacgatgtgatgttacatacagaacgggtaaaccttgtatcgctgctgcgggaaacgttaattgatatgttaaacgattctagatatacggataagtccattgaactccaaacgaacgtggaaaagctgatgctgaaccttgatgcgatattgattaggagagcggtcacgaatctcattttaaatgccctcgttcacaatgatcctgatgtgaagatcgttgtacagcttgaacaaaaagaacggactcatgtgacaattaaggacaacggcaaagggatagaagaagaggagctggaaaaagtgtttgatcgctattacaggggcacaaatacaggaacgacgcatgcaggctctggtcttggaatggccatagcaaaggatattatccaaaagcacggaggggacatcaccattcacagcaccgcgggagaagggacaacgatagatatacaattatcataatggctatacaaaaaaacggttctgttgattaataacagaaccgttttttcctattgttccgaaaacaatttgattcctttgacaatgttccaaatgaaaaaatagatcgccacaaggaatgtaacagcatacgtcgcaagcaggaaaggcccggcgtgcctgatgtcattcataccaagtaaacctgaagcgatgatgccaatcccaaaaatcaaataaggaatcagatgcgtccacaaagattttttcgcatgatatttcacatcgtcctggcctaagaaatagacgataatcggaaacagaaacggcgcaaaaaatatactgaagtaacataatgaagacaacattttattttctctcaaaccttttcacctctatgatttattgaagggggaattcttctggctgaatccctcactgaagtacaatcttattgtacaactccaaccttaacccgtattaatccgaaccttacatcaaccttaaattaacaaggacgggcaaggactcgtcttcttacagcaatcataagattcaatgccatattgagactcatcacattcagcgtgtctacgttggaaatacatttaatttttcgattcgattgaaaaatgacgtgtaaagtcccgattcagtccggttttctttgttctatatgtgtcaggtgtgtcttattcaatagagatagagcaaattgacaggcttttacacctcccaaaaacaagaaaatagattgatagacaatcatgagaaagatttttacaatgagttcgagctcataagaaagagccaaaatgatgcgaaggaggaaaagatcagatatgaaacgggcaatttctatttttattacgtgtttattgattgcggtattgacaatgggcggcttgctgccttcgccggcatcagcagcagagacaaaaacgccagtagccaagaatggtcagcttagcataaaaggtacacaacttgtaaaccgagacggcaaagcggtacaactgaaagggatcagttcacatggattgcaatggtatggcgatttcgtcaataaagacagcttaaaatggctgagagacgattggggcataaccgttttccgcgcggcgatgtatacggcagatggcggttatattgacaacccgtccgtgaaaaataaagtaaaagaagcggttgaagcggcaaaagaacttgggatatatgtcatcattgactggcatattttaaatgacggcaacccaaaccaaaataaagagaaggcaaaagaatttttcaaggagatgtcaagtctttacggaaacacgccaaacgtcatttatgaaattgcaaacgaaccaaacggtgacgtgaactggaagcgtgatattaaaccgtatgcggaagaagtgatttccgttatccgcaaaaatgatccagacaacatcatcattgtcggcaccggtacatggagccaagatgtgaatgatgcagccgatgatcagctaaaagatgcaaacgtcatgtacgcgcttcatttttatgccggcacacatggccaatctttacgggataaagcaaactatgcactcagtaaaggagcgcctattttcgtgacggaatggggaacaagcgacgcgtctggaaatggcggtgtattccttgaccagtcgcgggaatggctgaattatctcgacagtaagaacatcagctgggtgaactggaatctttctgataagcaggaatcatcttcggctttaaagccgggagcatctaaaacaggcggctggccgcttacagatttaactgcttcaggaacattcgtaagagaaaacattcgcggcactaaagattcgacgaaggacgtccctgaaacgccagcacaagataaccccgcacaggaaaaaggcgtttctgtacaatacaaagcaggggatgggcgtgtgaacagcaatcaaatccgcccgcagcttcacataaaaaataacggcaatgcgacggttgatttaaaagatgtcactgcccgttactggtataacgtgaaaaacaaaggccaaaactttgactgtgactacgcgcagatgggatgcggcaatctgacccacaagtttgtgacgctgcataaacctaagcaaggtgcagatacctatctggaactggggtttaaaacaggaacgctgtcaccgggagcaagcacagggaatattcagcttcgtcttcacaatgatgactggagcaattatgcacaaagcggcgattattcctttttccaatcaaatacgtttaaaacaacgaaaaaaatcacattatatcatcaaggaaaactgatttggggaacagaacccaattagttaagctttaggcggacatcagcaacgatgtccgcttttgtcatcttaaacagcaatacaaggaggtttacgtagcggatgaaactctgaaacagtatttgggcctgtacaaatgttgttagcaatctcaagaaagccaaggagtagctatgattcactgaacatatgatgtaatcgtttcacagttttgaaaagcgtttatagcgcaatgtgtgtatttcacatccgccacttttattacgtaagggggaacaagagaatgaaaaagtatgacgcatttccagagccaattggcggctatactgtcggccgaacccagatggattttgagtacacggcatcagatcatacaaaaagagaactgacggcgtttgtgtactatccgtccgacagcagcgaagggaagactacatcagcgtacatgtttcctgaagtctgcgaaatgcttgatgagcagccgcttctcactgcgttgaaggatgcttactctatagatatcaagacccaatgttacgacgaccttgctctctccgggaaggaaaaacgctatccggtgttattctatgtttgcggcgggggcggttctccagaatggggtacagtgatctgtacagacttggcaagcatgggatatgttgtagtaagcatcggccatcaaaatagcacgatgtataagcgtaaagatgggcgcctgtttaatgtatcaaaggatttttcggatgtcattatggcgttttctgaagatccggagatgctggctttggctggtaagatggagatacggcccgacgatgaaactgccattgagatgtgccaaaacgtgcttacactgccgatacttgacaagttaacagagtatagtgaattacaggcagaagatgtaaggtatgtagccgattatcttgtcaaattggattctggagagctgaattccatctttaagggcagattgttgcttgatatcggcatgggcatagtcggacattcttatggagggcctacgacggcgattgtttgccgggacgacgaacggttcgcctgcgggattggcttggatagcggagcgttcggccttcagggcagcgacattaagaaaccctttttgctgctgttttctgaaccgaactataacatgaatgcgatcattggcgctaacaatagcatggatacctattatttctctgttgatcgtgctgcgcatttagattactgcgacatcgtgtttaccagtgtgaataaggaacttagaggcgaacgggatgccatggagatgcgaaatcttgttacagactatacgaagaacttttttgatcattacatactgcagaaggctgcaagtatggaaagtctggcatacgatggcgtggacttgattaagaagaccagcaacaagtgacataaccgattaaaatactcaaactgaaaaacctttatgaccaatttaatttattaaggacgtagaggttttttaatattaccttacaaaaaggggatgttcttagaatatggatccacttttatattctctacataatttctagtttacataatatatattctaggaagtaaaatcttcaatgaaaattctgtctcgttatcttaagtatacttagttggtgagacagaattaaaaaaatcagatgtattacgatttataattaaccttgaacataacaccatctttaataatcacctcgcactttacttcgtctacatcagttttgccattggataatcttgtgtacacataaacccaattttcaccgtctcttttgaagtaatcaaaatcgtaagcattcggatatttatctcttacccaaattaatcctggcagagtctccgccattgctggtgatccagatactagcaaggacccaccagtgctgtagctcctgctatcttcttgaatttactttttaacatttttattgcccccttttgatttgttgcctgctgcttactcacttagcaggcaatctgattttatcaccttgcaagagggaaatttgtcatattttgtagataagagtattactttcggaaaaaatacaaaattatgtcaattattttccattcttgaattctgaaacttttcggagggcttctgatagcgatcctctttgcaaatgtgcttacataaaaaaaaccggcgtgttggccggtcctttcttctagacaacatgtacccttcttgattactcgtgaggaagcattaaagcctttattaagcctcgtaatttctgctgtttgaacctaaattcctaaagagtaaagaagaaagcagagctaacacaaaataaacaacaacgaatccaccccaaaagaagatagcctgatcaaatgggaagccaaacactctaaaaattattctgtgtaccactccggcaataatgaccaggatgcttgctgataacgcaaaagtaatgtgtttcaatttaaacctctccttatgaaagattaataactctgtcagacccattggcgatttcttgatcgtgagtaacacaaataattgttttccccatatcttttaactgatggaataaagacaagataatgtttttgttatattcgtctaagtttcctgtcggttcatcagccaggataatatcacaaggcttcaaaataattcttgcaatggccacacgttgttgctctccgccactcagttgataaacctttttctttaaaaagcttttatccagaccaaccatttctaaagcttctgtcaacttttctttcttaaagtcttttgcataagccgtcgaaagcagtaagtttgttaatactgtttcattgtccataagcacgtaattttgaaagatataccctaagttctctctccgcagtttcatcacgtcgttagatttaggatttcgaaaacctaaaatttcaatatctcctgagtgtggagtatcaagaaggcctattatatttagaagggttgtcttccctgaaccgctcttaccaacaattgaaacaaattcattttcttttatctgaagagagaaattcgacagaacaggtttttcattaaacgtctttgatatgttgttgagtgtaatcatattctatctccttttaagatcttatgcatgtttttcttgtttaaatagacactcaggaaataaagaataagcagctcgattacaataaacagcccaacaaaaattgttaattcaaagattctataatatatactgatacctaaaccaataaggcaattggatagaagagaaaagatgattaaatttttatttctggcccaatatgaatatccaaaaagctctttaaggtacagccgatatgcattcgcgctgtaatacgaccaaatataagcaacaagaaaggcgatggagaggataactgttattgttagtccaattaaattctgcaagaattgattctgaattcttgctataccgtcgcttagttcttgataaaccgaaattgatgaatcaattagatctctcgtattggtcttctccaaataaggaactatgcggtcatacgccatgccttttgaagaatctgaaaagaataaacttgaggttgagtaagcacctataacagatggatcaacgttgtccgtgaaaattgcagctattggatcaacaatgttatttttattgccggcatccccaaactcactattaaaggtgaaatactcctgcctatttttagtataaatgatgttgattttcaattcatcttttttaagggtgtttaaaggttgattcatctccttgttatacatattatctaattcaactttgtcaaagaaaaactgatccctgtatgtagctattattttttctttaaattttcatacttttgtggaacaagcaggttcaatgtatttgaatcaacccttaattgcttttggcttatggcttccccattagcgccgataatgggattcacctttaaataattagggctgattgtaatacttcgtccagaaggagagtaaatttcatttttctttgtcgtatttaaggtgtaaaaataaacaggtttttttccgtctttccttagtacagcatagttatgtgcatcaatgacgaacgcatttttatgcttctctaattgatgatacaacgcgcgaactctaacatttttctccctgtctaattttaaatcactatagtctatcccggtatttgcaaagcttgtcttataagtgttttgtgtctttttccagtacgattgattatcaagctgctgtttgagatcgaatacgttagaaagtgaaaacgcaacaatattgaagagcaatatcgtgacaacaattttaaagcctacagataaccattggaattttttaatcggtgtgctgcctttgatcgagccactaatgtcgctgttgttatacaagacgagggtaaccatgatggtgtataccatcatgataagcgcaccaatcaccgcgtttctaatataaattctaagatatgcagccagccagtcatttaaattgaaagaaaaagctagtaaagctacaataattgcaccgcaaaatatgattataattagaggcttcaaaaacattgctgggtaagaaagcagtgttttaactttggaatacccccataacttttgcagcagaagccgtttgcgatttttaattacaaaataaaggacaccaataaacaaaatcagcatagaaagcaacactagcataagcaaagttttgttaaacataaaagcagtattctcagtgatgttttcaaaacttacttcaccatagtcagcaaaaaaggttttgtgctttctccaataccttgtcatcgttagatgaaatataaaatttgcttcctatgcctatattctttatttggttaaaatcaaaatatctgattttccatgtcgagagtggaaaagaaatgctgccgatcatcttctgatttgaatgatctcttagaaaatttgacacaagcttattgccgttatatattgatggttcatttttaggatttgtagaatagatgtttaagctcttctcatctaagaaattgtattgagaaatgttcactttgttttctttggagaaggcgaccaatctctttacaaagtcctcacttttaaattctgaagtataattgattatcaatgcttctttatttgagaataaagtgtaatagatttgtttgttaagagtgtaatgatagcttgacatattcattgagagcaaaaccagaatgaacaatatgtagattgttttcttcattggacagcctccataaaaagaaatccggtgctgtcttgtattcaagtttgaccacaccggaagaaaaatttaaaaatcactttgctatcgttttctttattttgtatcccaaaaagccttgtttccaaaaagggtttgatacacggaagcgtaggtatacccttcatcttttttcttccattcggttacctgcggaagcatgagtgatccgataatgcacagttaaaaatttcagtccgaacagccacatatgatgaacggccttcaggcttgtttcgctctgggctgaaataagaaatgtctctgccagcggaagatgacacgtcccccatttcgtctgcagataaatcccttcatcacccgctccgctttttcgccgtctgcttgtcaaaagaagattctgcttacgcgcataaggctttaaaatgcccgtcatttggccgtacggcagcggaagagagatattcatgtatccttccccttttgccctgtacgctgaatacagcgcagtaaaaacggtttcctgcttttcatttgttctgatccacgcacggacattttttctgccgtctttatcagagtcaactcctataatatcactgtgcatgatataccaatccggattcatggacaggtgaatctgccccgctcttctgctgaacggctcgtacacgcgcgcgaacggacgaaaccatccgctccacgtcacttttgccatgatgtcataatcaattgttttttcataaaaggaaataacggccggcgccagttttttagttgaaaagtcttcagaatgcagttctctcatctgatccagaaggccggtataatggatgtcatttgctgcatgaatatcagtcaaaaagtctttgcctatcgttctcttcccgtaaatacggctgaacgttctttcgctgccctcatcaaacggtctcggattttccaacctccaccccgccaaagccggcaggataacgccgaatgcattgacggccccgtgaatccaaatcatctggctgatcgtgagcgttgcctcctcgcggtagacaccgtacgaatatatcaaagaaaaagcaattgtgatcattaacacagccgaagaactcctgatcaagatcctgcctgttttcgtaacaaacggcgccgtaaagacgagatatgcatttacatacagacccgccagatacagagcgacagcaatcacatcaagtgtctttgaaaatgtaatccccaaggcaataaggatcggcgaaatcaaaataatgaccgtgctccatctgtaaagaacccgtttctcccgtatgatcctgccgagcaatccgttaaagatcggaatgagaaaagcggaatagtgaaagtgcaccgccgtcagcagaacgataagcgggccgaaattcatgacgggaatctcaaggacatatgcgaagaaccagaatccgcccccggccaaataaatgaaacccgccataacagacatctcttctgttctgtgaatatttgttttcatcagccgccggacagcatacagtgccagcccaaccgtataaatgagccacacaacggcaaaaaaactgaagtctgtgacaagcgcaagcaccgcacataaagcggcaacaggataactccgtaataacacattctctaaggtctttgacggtcgaaaagcaaaatcgaatacagcgggaacgaaaaaaagtacggaaaataaaacaaacatctcagcagctgatatatacggagcttcagccgccgcaaatcccaaaaagcaaatcacgcttaccatgagatgacgcttcagcatgtttctccctctgtttcccggaaagtcccccggtaagagaaaagcgtgccgagtatccggttttttacatgaacctttatgctgaagcaattcatttcctcatcataagcctcataaacggttgaactgccgcacagccatgccggaagcgggattttctttccgactatcaggagccactgccttccggatgtaataacaagccctccgtctgaagacgcttctaaatgcagttcagacagtaggatgcggggtttgccgaagtaatcaagaattctgttttcccgctcatcatactccatgaccgcatcaaaaaaacgcggtttgcttttaaagaaaaaggtacgattccattccacgccattttgcctgtttttgttttcgatagtgaaagggatatcgtttcccctctctgagaaaaaacatctgaaaaaaacacctgtctttaaaagcattctgacaagaaaagaacctccctttatttctgacataacgccttctccgcaaaacgtgcgtgatccgtcaaatctgtaccgtttctgcagcatcgggtgcagtgattgataatgagtaatcgctttttcatacattgaatccgtcatttcacttctctctttcgttttgtatgccaggcgctcggcagcttgagcttaagaatcattgcggctatcgtaagcattcctaatgagatcacgaatccgccgcccgaatatagcagtgccgttacacaaaagaagactgactgcccggtgtgaatcagccactttctccgcatgggaagcagccataatacccctaaccctgtctccagcgctcccctcacgatctctgcatcggcacagccatcatgaaagccttgaaaaaaccaatacagactgaatacgagacacataaagacatagacaaacccgaaacggactgatatcttcggatgtctgttttgttctatccaaagccgcaacgcatcaaagctccatgcggtagcccagcttagcagaggacgaaataaaaaccggtctatccaacttcccggcagaccgcgggccgtttcatattgatattgagtcaaaaatgcggtttgtccgttatcccgctctatatacttccagtagcccctgccttcttttataagtgacagcggatgatcagaggcaaaagcgagcgaagacactctttctgacgagcgagaccttatgtcacctattgattcgcccgtgccggataccttcagcccaaaaccgattcgtgtttcatatagaaatctctgcggttcatctggcagcctatgaagatatgtaatgtcagaaaaacgcagatcccattctttatgaagatgcgggttttgcgtatattcccaaagcgtttctatatcagatgcaatattgatttcgacatatatcggcttctgtttcatgccccctcctcttcccttcttttgtaaacaattcctatattatcataggaacagatcaagcggcagaacgaaaaggccatcccgttatcggcaggacagcctcagtggctttgatgacttatgaataaggtatcgtgtcttttttatcttcagaagcggtttgaatgataatcgggcgcacaaaacggattaccgcagccgaggccaaagcggctaatccgcctgcaagcaaaaacgccccggagaatgatccgcttttgtccgcgataaagccggttaaagcaggcccgataataccggccgtgtttgcaagaaaatgcataaagccgccgactgatccgacattcctttgatcaaccacatcatgaatcaccgcccaatagatagagcccgttatatataaaaagaagactgataaagcaacgagaataacggcacttacggtagtggtaacaagtccggcaaatccgatcagtacagcggaagcgaacaaacaagtgacaagaatgactttccgtgagaacaaaaccccttttccggcggtttttttgaatacataatcagaaatcattccgcctgccgccaaaccgataaatccaagaatccagggaataacagtcaccacgctcataaattcaacacttaaaccgcgttctttcaccagatagctcggaaaccatgttaagaagaaaaataagatgtaattgtaggcgaaaaaggcaaaagctgtgaagagaaccgttttttgtttcaaataaaaggtcatcgggatatgctgctcatgcggttgaatctccgctttcattgccggggcgtcttccgtcggcgccggccgttctttgacaaatttaaaccagatgaccgcccagactaaaccgatgatcatgatcaggacaaaggaaactttccagctgaacgccacagcaatcatcccgacaatcgggccggaaatcgccccgccgagcggcgttccgctgtttgtcaggccgatgaccgtggcgcgctgagacggaggaaaccaattgttgaccattttgcttatggcagccgacagcggcccctctcccataccgaataaaacacggataatcaaaagacttacaaatccgaaagcaagcgcaaccgctccgctgaaaagagaccaaacgatcatcgccgtacacaatgtcaatttagccccgtaccggtcagatgcaacaccgccgagaaagttaaacacagcgtatccgacagaaaaactgctgaaaatcagccccatttgggttgccgacaatgtgagatcctgctgtatgaacggcgctgcaatagacagcgctgagcggtctaaatagttaatcaccccggctgaaaataaaagaagaagaatagggaatctatcttttgagaacataaaaaaatccccctctcatttcgcaatattcagacatttaaattgccggagtaaaccggtttatgcaatgaaaccggttatccggattgccttgcgagcaacgccggtttatagcggtaaatccgtttttcaccgccatctttttcttgtatctggcgaagaagaaggcttcccgcttttcgtgccatttctgccgcaggctggacgatcgtcgtaattggaggagtaaaaaaacccgcaaaaggaacttcatcaattccgatgacggctgccttatccggaattgtcatatcatgctccttcatatacttcagcacctcaacaagaacgatatcgtttgccgccaatatcgctttcggaggctcctcaagtgagaacagctctgacaaaacattggaaatatcagctgcatcggctgttttgatatattcgtcccgcaccatcattccgtggcggtcaagcgccttcttatacccttcaatcctttctaccctcggactgatttcccgaataatagacgtcgtaataatcgcaattctcttaatgccgctttcgataaaccggtcaacggcaagaccggctgcatgatggttatcaagcatcactgtcggaatcccgagttcttcaatggttctgtccataaacacgaccggaaacgtatcacgtttcatcttttcatataaagagagattttcgcccgtcggaaaaataataattccgtccacctgcttagcccgcagcatttcaatatatttcttttctttttccggttcatcatccgcattgcagacaataatatgaaatccttgttcatgaaaatagtcttccaccgccctgatgacctgagtggaaaaagtgtgaagaatattagccaccaccacacctactgtaaatgttgatttctgttttaagctgcgggcgacgaaattcggctgatagttcagctcttgaatggccgcttctattttttgtttcgttttctcgctcatatagtcatagcgctgatttaaaaattgagatacggtgcttttagatacgtttgcatatttcgccacatcagaaattgtaatggttttcatagactcatccccgtctgtcttcatttttcactagtataagtcagaagtaaatggtttacaatctgacagggacatggattctgtcacactccggaataagccataaaacctccgtcgacgggaacggtgaccccggtgacgaagcctgagcatgaatcatccgaaaaccacaggagcgttcccagaaggtcttccggtttcccgaaacgtttcatcggtgtatgtgccataatcttattggatcggtctgtcagacttccatcttcctgtaataacaacccacggttttgcgctgtcaaaaagaaacccggagcgatggcattcacccgcagccctttttttgcgaaatgaacagccatccacatcgtaaaattctgaatcgccgccttggccgcgctgtaggcgggcacctttgtcatcggtgtatacgcactcatagaagaaatattaataatcgcgggacattccgccttcaaaaggtcttttccaaacacttgcgatgccagaaatgcaccggtaaagttggttgaaaatacgctggaaaaccccgtttcgtccatatcaaaaaatgatgtgccctgctcatcctcttcatacgtctcgctggcagtgatcgcatcagggtggtttcccccggctccgttaattaaaagattgacagaaccgaaccggctgataatctcgtcttttgccttttcgagcgaatcacgggctgaaacatcagccggtacagaaatcgcggttcctccagcgtcagcaatctcgcccgccgcacgctctgctttatcagcattccggctgacgatcgcaattttcatcccctgccgtgaaagctcctttgccattgctgaacagagaacaccgctcccgcctgttatgacagcggttcttcctgataaacgttcatgaatcggtctcatcccttcacctctttctcatgagacgagaacgcatcccacagtccgttcaagtacataattcctaaggcacgatcatataaaccataacccggccggcattgttcgccccagatatgacggccgtgatcaggccgtacatatcctttatagccttggccgtgcaattcttttaccacaccggtaatatcaatggacccatcactggtaagatgcgaagtttccgtaaaatcaccgttatcgcagattttcacatttcgtatatgggcaaacggcgcagctcccgcatagtgtttggcgatcttcaccatatcattggcgggattcgctcccatcgaacccgtgcacaacgtaatacaattggcgggtgaatctgaaatctctcgcagcttttcataacttttctcaccggtaataatacggggcaggccaaaaattgaccagggcggatcatccggatgaatggccatttgaatgccgtgttcctccgctacaggaaggatttcatgtaaaaagaactcaagattggcccaaagctgtttttcatcaaccgtttgataggcctcaaacagttccttgatccgggccattttctccggctcccacccgggaagcgtcaaatcagaagattcttcaaccgtgcggatgagttcctccggagggagactttccactttcgctttttcaaaaaacaaagcggttgacccatcctccagcgcgcggaacatatcggtacgcgtccagtcaaatatcggcatgaaattgtaacagatgactttcacgccgaattcggacagattgcgaatggtctgtttatagtgctcaatatattgtccgcgttcttcatgaccgagtttaatggcttcatgaacattcacgctttccacgatctctgcatgaaacccataggattgaatgtttctgacttccgcttcaatgtcctccttttcccatacttcgcccgcgggcttctggtgaagagcccagacgatgcctttgaccccgggaatttgtctgacatgttcaagagtcaccgtatcattaccttggccgtaccagcgaaacgtgatattcatgttacacccccgtatattcgttttttcggcagacgtattctttgctgagggatacggcagcttcatagccgcccttttgatatgcttttgtcaagtcgcttcccacaccgaccgcgaccgctccggcagagagccagtcattcatgctgtttaatgagatacccccggtcggcataatgcggacattcggcagaggaccgttgaccgacttgataaatgaagggtcaaacgaattagcggggaacagctttaccacatcacatccggcttcaagggccaaagccatatcagacacactcatgcatcccggaagatacggtacgctgtactggttgcatagagatgctatctcttttacaaaatgagagctgacgataaatgaggcgcctgataaaatggcgtgtctcgccgtttctgtatccattacagaaccggctccaagaagaatatcttgatgccggagttccttaaagacatcttccacttcaggagttgtgtatgtaagctcaatggcgctgatacctcctgaaatggccgcttttgaaacttcaagcgcctcttggctgttttgtccccttatgacagccaccacttgtgcatgcagaagtttttcgtaaatggcgtacttaggcagcattctcgctcctcctttaatcaaacgtaatgattgcttttcccaccttgtccgggtgctgttcgatcaactgaaatgcttgatggacgtcatctgctgaaaatgtatgtgtaataagaccgccgtgcgttaacaggcctttattcagtaagtctgtaatgtacggaaactgattcgtctgcaatcttgaaccggttatcgtgacttccttttttgtgatcggaagctgagaaatgccggcagtcctctcatcaaaaccaagcacaaccacatgaccggccggagacaccgcgtcaatggacgtttcaaacgttgaggggagacagacggcatcaatgacgacattggcgccttctttttttgtccattcgttcacccgcaaaacgggatcttctttttgcgcgttgacggtaacgtccgcaccgtttttttcagcgaatgccaagcgttcatcattcaagtcggttatcatgacagtagcgcctttgaactttgccatttttaatatgcagattccgatcggtcccgctccctgaatcaaaacggtatcttccttctcgacacggcctctccaaacggcctgggcgccgatcgtatatggttctgccatgaccgcttcctcccaggccagatcgggggaaacggcatgcagctgcttttccggaaccacgatatattcccgcatcccgccatcttcatgaacgccgaacaccgaaagcgctttgcagacgttcggacgtcctttccggcaggcatagcatgttccgcaataagatatcggttcaaccactacgcggtcacccggcttgaaacgccggacatgagaaccggtatttgcgacttcccctgtaacttcatgtccgattactctcggcagggacgctaacggatttgtcccatgataaatatgcaaatctgatccgcaaattccgacccgcttcaccttgacaagaacatcatccgcgtggacaacagacggtttctcacattccgtcaccaccagatcaaatgctttccgtactagaaccgctttcattttctcacccgctttttaagttgtgcttgctaccgttcaatcacagtctctttgtttacaaatgacagaacctcttctagatagggaagcccttcattgtcaccggaaactgtggtgacgagcgcaccgaccgcattggcaaactccagacgtttttccggttcaaaaccatgcagataactgtacaggtagccggcattaaagccgtcacccgctcctaccgtgtcaacaggcgcaaccgggaaagcctctttgtgaatccacttatgatcatgatacagcgcagaacctgcttcaccgtcttttatgacaagctgactgattgaataggtctctgcaaaccgggctaatgcttcattttcccctatacctgtcagctgtttcatttcgtcccggcccgccagaagaatatcagtatgcggaaagatttgatgaaatgccgcacgcgcctcctcgatcgtccacagcttcagcctgatattcggatcaaaagatacgggaatccctcttgctttggcgatggaaagcaccctttcagcaatttcaagatttttcttatcaagcgcgaggaacacaccggtaagatgaacaatgtgaatgccggcaaacatattctctgttatatcttccggtgcaagagtcagaattggtgaattgaaacgataataaaacgtcttgcctgaaccgtcatttctgatctctttgacatttaaagatgtaggaaagccttcaacataggagacgtcagtcacatcaattccttctcctttggcaaactgataaatcactctgccgaactcatccttccccagtctgctgacccactttgagtgcagattcaatctggcgcatgcaatcgcaaaattcagttcagctcctcctgcttttcgttcaaaatgggtaacaaaacgcaaaggtcctgtgcttgcgggatttaaggtgatcatcgcatcaccgatcgtaaaaatgccataatcagaagccacatcaatactcctttcttttaagactaaatcggtttggtaaaccggtttagtaaaactttatatgaaaacccttacacacgcaagagaaaaatacaataaattcaaaaaactgttttcggtaaaaataacccggtttttcacatgaaaaaaccctcacaacaaaatgtaaggggtttttgaaaattgtatgcatgtttccttagttagcagtcttacgttcggggcttgtaccttcttcttccgcccatgtttcaatatgcttgagctccggggtattctcggctttgaatacgggatcaagaccttttttgcgctgagcggcataatccttatagatcttgtaggctacattactcagcagtaaaattgccactaagttaatgagagccaagagtcccataaacaagtttgccatgtcccagacgatctggaagtcagccaaacatccgtataccaccatcactacgacgaatacgcggtaaatattaagccatgttttgcttgttttaataaattcaatattcgtttcaccatagtaatagttgccgaccacagagctgaatgcgaataaaaacatcgcaatcgcaataaatgtcggggcccagccgccgaggtggtgctgcaatgcggcttgtgtcacttggatgccgtcgcctttaggcgtaaagctgtacaataaaatgataaaggcagtcgatgtacaaacaataaatgtatcaaaaaacacgccgagcgtctgaattaatccctgcttagccggatgcgacacatgtgcagccgctgcggcattcggcgcgcttcccatacccgcttcgtttgaaaacaggccgcgctgcgcaccgataataatgatgcttcctaagcttccgccgacgatctgttcaagaccgaacgcatttttcacaatcgtaacaaacagctcaggtaccgctgtaatatttacaatcacgacatacagcgcgatcagaatatacatgcccgccatgaccggaacgattaattgcgaaacggaaacaacacgtttcagaccgccgaatataatgaaagccgttaatacagctaaaatgattgcgataactgttttattcacatggaatgcttcgtcaaacgccacagaaatcgtatttgactgcacggcgttaaagataagtccgaaagaaacggtaatcaatacggcgaataaaataccgagccagcgggcgcccagtcccttagccatgtaatatgccggaccgccgcggaattcgtcaccggaacgcactttatacagctgcgccaaggtgctttccacaaagctggaagccataccgacaatcgctacgatccacatccaaaatactgcgccgggaccgcctgttgcaatcgccagcgcgacgccggtcaagtttccggttccgacacgagaagcggctgagataaagaatgcctgcattgaagacactcctttattcccttgcggcttctccccgacgattctgaacatttcaataaagtattggaattgaataaagcgaaaacggaacgtaaagtacaatccgatcccgactaaaatataaacaagatacttccaaataaaatcatttggaacatttatgatttcactgatgaaagcctccatgtttaacctcccttttacatatcttttactgtcatttttgctgcatatgttagatcttttaacacaacgagtattattatatcacaacaacagtggttgagaagtttttttaagaaaatgtttcggtttcttcatcacgtcttttgctgtcatgccccgttttttatcttacagcctgaaaaatgttgtcacgtcataaggaatgcgtgcatatcataacaaataggtctttaagaaaaaagagatgaaaagatggatggaatggtatatacttaaccaggataataattttttaaatttaataaatatgtttactttacatttaaattagggtattataataaaaatattcagacttatgaaggggggagaacatttgaaaaaaatcttgtttttaaaagcttctattttatttttagcgattgcaagctttcatttgctctccattccccatgcgtttgatactgctcatcattttaaagcggtagccgaccagcaggaaatgcacgaaatgaaggccggccaaaatgctgatgatgagaaaaaatcgctgacgggctcatatatcttgacggcgctttttgccgcttctgtctcactgatcgtgatatcagacaggagacgccccgcttcccggagaagacagcgaaagaaaagctttttaatcgctaaattttatcagtcctcgtatttcgatgagcttcatgttcaacatcgcctatctatgtaacataaaatgaggaggttgttaaacatgttgtttatcttacgaatggtgattttagggttgttttcattcactgcattgaatttatttgtatggcagggaatcgaagtcattcacgctatcactgacttattcggcagccatgaaagctaaatagtaaaacctccgctcaatgagcggaggtttttttattttatttttactcttaaacatcagacgcggggatacgccatacatctgttaccggccctgtctcatcttcatcggtaaagaaggagccgttgctgtatcggtcattcgcccgcaaggacttcacggcgatttcaattctctcgcctttttctgtttccgcagcgatcatgtcggctaaagcgcacgcgaatacgccgactgcgcgatgcgggttctttttaagctcacgcagcatgatgacaccgcgcttcgccctggatgttttttcgaattcagataggttcatccgcttgattgctccccgctgtgtgacaaggacaagcgaatctgtctcatgcaggatttgtcctgatacgacggtatcaccgtcttttacatttatgccctttacgccggccgcacgggcaccgactacatttacttcatcttcaccgaaccataaaccgtacccgaggcgggtggcgataaacagctggctgccgccgtctgtgacatgaacatcaatcagctcgtcgtcccctttaaggttaagggcaacaagcgctttcgagtaacgctgcgctttgtaatgcgtcatttcagttctcttcaccatgccgtttttcgtcataaacaataaatatgaagatggatcaaattcttttaccggtatagctttcacgatggtttcatcacggtcaatcgtgatgatgttcgttacgtgctgccccatgtctttccacctgatatcgggaagctggtgaaccggacaataaacatagcttcccttattggtaaagagcaggagaacatccgttgtattcatttcaaattggtgaatcagcctgtcagtatccttcataccgaaatcctggccgttagaagcggcaaatgaccgctgacttgttcgttttacatagccgtcttttgtgactgtcacatatacgtcctcagaggctaccatgacttcaagattgattttaatttcctcaatcttttcttcaatgacagaccgtctgctgtcagcataggtctttttcaattttttcaggctgcttgtaatgacttttaacagctttttatcatgacttaaaatggcttcgagctcctgaattttcttgctgagctcttccgcttcctcttttagcgccgtaatatccgtgtttgtcagacgatacagctgcaaggatacgatcgcttcggcctgcggctccgtaaatgtgaatttagacattacgttttgtttcgcatctttcttgtcgctgcttgcccggatgacggctatgacctcatctaacacagacagtgccttcatcagtccttcaacgatgtggtgccgctcttttgctttttgcaattcaaagacggagcggtttgtcaccacttccttctggtgggaaatatacgcatccaggatggccgtaagactcatcagcatcggccggcggttatgtatggcgaccatattaaagttataagttgtctgcagatcagtgtttttatataagaaattcaaaatgccttttgcatcggcttctttctttaactcaacgaccacccgaagccccgtgcggtcagtttcatcccggacttcagaaatgccttcgacttttttgtctatgcggtattcatccattttctttacgagattggctttgtttacttcaaacggaatttctgtaatgacgatctgctcccgtccgcctcttacggattccacttcagccttgccgcggataataattttgcctttcccggtttcataagccttccgaatgccgtcgactccttgaataatgcctcctgtcggaaagtcaggccctttaatcacctgcatcaagtcatcgacggtgcaatccggagattcaatccgtttaatgacggcatcaatgacctcacccagatgatgagggggaatatcagtcgcatagcccgctgaaatcccggttgatccgttgacaagcaagttagggaacatggcgggcaaaacaaccggttctttactagtgtcatcaaagttcggaacgaattcaaccgtatttttatcaatgtcacgcaaaagctctgatgcgatagaagataatctcgcttccgtataacgcatggcagccggcggatcaccgtcaatgcttccattgttgccgtgcatctcaatcaggacattccgcactttccaatcctggctcatccgcaccatcgcttcataaacggagctgtcaccgtgcggatgataattaccgataacgtttccgaccgttttcgccgctttacggaaatttttatcgaaagtatttccgtctgcgtgcatggcgtataaaattctccgctgcaccggctttaaaccgtcacgagcatcaggcagcgccctgtcttgaataatgtatttactatagcgtccgaaacggtcgccgattacttcttctaacggtaaatcatgaaataattctggctgtgccactattaaacctcctcagcgaccgacaagttttcattttctaaaatattgctttcctcatctaatccgaaggcaacatttttttcaatccattttcttctcggttctactttgtctcccattaatgtcgttacacggcgctctacccgtgccgcatcgtcgatcttgactctgacgagcgttcgcgattcgggattcatcgtcgtttcccagagctggtctgcgttcatttctcccagacctttatagcgctggatggtataccctttgccgactttctttaaaacgccgtccatttcttcgtcggaccaagcatattcaataatctctttcttaccgcttcctttgctcactttgtaaagaggcggaagggcgatgaagacttttccgtgctcgattaaaggtttcatatagcggtagaaaaacgttaacagcaagacttgaatgtgcgcgccgtcggtatccgcgtccgtcatgatgatgatcttgtcataattgatgtcgtctatctcaaaatctgcgccgacaccgcctccgatcgcatgaataatcgtattgatttcttcatttttgaagatgtctgcaagctttgctttctctgtgttgatgacctttccgcgaaggggcagcacggcttggaatttccggtctcttccctgttttgcagaacctcccgcagagtctccctccacaagatacaattcattcttcgccggatttctggaaccggccggtgtgagttttccgctcagcgtcgcttctgattttttgcgttttttgccgcttctcgcttcttctctcgctttacgggccgcttcacgggcctggcttgctttaatcgcttttttgacaagcagggttgctgtatcgcggttttcttccaggaaataagcaagattctcggaaatgacggcatccgcggcggatctcgcctcacttgttccaagcttccctttcgtctggccttcaaattgcagcagttcctccgggatacgcacggaaatgattgcggacaaaccttccctgatatcggcgccttcaaggttcttgtctttctcttttaaaagggctacctttcgcgcatactcgttaaacgctcttgtcattgccgttttggctcctgattcgtgggtgccgccgtcctttgttctgacgttattaacgaatgacagcatattttctgaatacccgtcattaaactgaaacgcgaaatcgacttcaatgtcatgatgctcgccttcaaaggaaaccacttcgcataaagcgtctttttcctcgtttagataagcgacaaatgcttcaattccgttctcataataaaatacttcttttacgccgttccgttcatcaattaattctattttcaagccttttaacaagaaagccgattcgcgcagacgttctgacagcgtgtcaaaattataaaccgttgcgctgaacattgacggatcaggtttaaaatgggtaagcgttcccgtttttttggtcgttccgattttttcaagtgaagtcacgggcttgccgccgttttcaaaccgctgtttataaacatatccgtcacgctcaatagtaactgtcagccactccgataatgcgtttacgacagatgcgccgacaccatgcagaccgccgcttgttttatagccgccctgtccgaatttccccccggcatgcagcacggtgaaaataacttccggcgtcggctttccgagcttatgcatcccggtcggcattccgcgtcctctgtcttgtacggagatgctgttgtccttatgtatcgttacgataatatgatctccgtagccggcaagaacttcatcgacggaattgtcgacgatctcatataccagatggtgcaggccgcgtgcgtccgtcgaaccaatgtacattcccggtcgttttctgacggcttccaggccttcaagcacctgtatggcatcttcgttgtaatcaaattgctgttttctagccaaacgtacaaacccctttcaaaaaacctgctcttaatcattctcttttttaaatgttttcatgtctttgtttttcagtatgcgcaagcttcggtccaattctcctcggactcacaattataaccaatatgcttgatttcgcaacatatttaagcgaatggctcgttttttaggccgcaagacatacattcgaacggcttttcatctttttggtgccctttttggcgaataagaacatgagttcgctttctattatatagctttatgcgggccatcgcaaacagactgtaaacccctgtataaaggggtttctaaaaaagctgttcatgctttattgtatctgtttcatcatcatacgcaaagagtattctttcaataaaaaagcaaaaacccctgatttgccaaggatttttgccttttttgttcctattttataacagcgcgggcgacttttatacataaatccataacagccgtccgtcctttgtctgtaatcatgcgatacgcttcttcatttgcaaggccctgctgcgcccaaaaaacgggagcgtccgtctgtaaaaattcttcagcgacgccgggaagctgctcagagcgtctgaacacattcacgatatcaatcggtccctccacgtcttttaatgaagcgacggctttaacgccaagcgcctcatcaatcgttggattgacgggaataatttcatacccttcattctgcatcgctttggaaaccatgtaagaagtccggtcgggacggtctgacagcccgacgactgcgatccgtttgctccggtccagaatttctttaatctctgattttgaaggattttgcatctttaccatctccttttgatatattgtacatgaccgcttcgccggaatcaaaaaaagcgctttgtcagcttaattctcaaaaaacttgtcatcagacggtaacaactcgtgttaaaatagagtgaagggacattgaaaaggagaaatgtagatgttgattgctttattgattattttggcctatgtaataggcagcatcccgtcaggtttaatcgtaggcaaacttgcgaaagggatcgatattagagaacacggaagcggcaatttgggcgctacaaatgcttttcgcacgcttggcgttaaagcgggatctgttgtcatcgcagccgatattttaaaaggcaccttggccgcggcgctcccatatttactgcacgtccccattcatcctcttctcgcaggggtggcagcagtaatcggccatgtattccccgtgttcgcaaagtttaagggaggcaaagccgtagccacatcagggggcgtcctgctgttttatgctccgctgttattcgttacgatggttgtagtatttttcgtatttttattccttacgaaatttgtttctctgtcttcaatgttaacagggatttatacgattatttactgtctgtttgtaaaagacccttatttattagtcgtagtgacgctcttgaccgcgtttgttatctacagacacagggcaaacatcaaacggattataaacaaaacagaaccgaagatcaaatggttttgatgaaacttcaattttgacatcaaaatgccatatgcgtttataatagagataatttctttatatgagaaacaaaaagggagtgttccggatgaacatgaaagtaacgaaaggcgcgctggattggtacaaagaagagctcgatctggaaacaggcgaccatgtccgtttctttgtccgttacgggggatgcagcaacgttcagaaaggcttttctctcggcattttaaaagaccggccgatgaacatcggcaccagcacggaagttgaaggcattaccttttttattgaagaaagcgacttatggtactttgataatcacgatttgtcagtcacatattcagatcaggcagaagagccggtatttgattacgtgtaagaaaaaaagaacgcagcggatgcgttctttttttacagcctgaaccttttgagatgatcagtcagatgttctttttctaatatgcttctttgcgtatcaccgagcaggtcaaagtggggaaattcatttttatggtgaatccactccggcttcagcccatactcagctccccatctgatcagtttattgagatcgcttgaaccggccttcgtcacggtcttagcctccggaaagcggtcgtccagccagtaatgcgttaaaaaagcgattttcccttccgatacatcccgcttccatctttccagttccttacgcgtaattccaaatgccataactgcagccgctccttatttttttgccttttcgtaagcggcatgccaatcaggaaaagccttgcgaaactgaatcggtttgaagctctctttatcaacgcatatatgagaggatgtcgctttgatggcaagttcttgatccggattatagatgtggtagccgtaaacggttttaaatccgttatattcttcaatccaagtatgtacgacagccgtttctccgtagcggagcggctttttataagaaatgctgatatccaatacaggggacagcactcctctgtcttccatatccttgtaaaggaatccgagttccttaatcagcgccgttctgccgacctccatccagactaagtaattggcatgatagacgatacccatttgatctgtttccgcataacgcacttctatttctttttttgacacatgcaacgttctctgctcccttattatcagattagccccattttatcacaacgagccggaaagagaaaaaaaccaggtttccctggtttttattatgattgatagccgttttctcttgcagccgattcatcctggatttcactgcggaacgattcaatgctttcattgcgtctggcattcttctcttgaatgcgctgtttttcctcatctgtcgcaaattccattgattctttggcttcttctatattttcaattgtattctgcaccatatcctgcagcttttcaacgttatcggaacggtcatccggattcggtttttgataattgtttgtcataatgtctgctctcctttgatgatgttattcgcctttcgtctgcatgacaatcggatgtccgtttgacttgtcatgaaacttttcccctttgttgcgtttatatttaacgggttttgtccctaagtggctcggagcgtattgcggctggccgtctttcttgtttatgcccatgttcatccctccttaagagtatattttgcaaaaggaggtgcaaacatgactgcaaattaaaggttatttttgtttgaaccgctgctccagcttttcttcaagctgattcaaatattccgtattggtcatcagctcacgtttattttccataaccaattcatgaaaagaacgttttcgcatttttttcaatcttctcacctccgtgttttcattcattttttccaatttttcaaaacctaagcccttcacaataaaaaaactgaacctctatttgagatccagtttttctttcatttctttttttgtcatcgtgcctacgcgaatatgctgaatggttcctttttcgtctaatatgtatgttgtcggataagaaagcacgttgaaatctccgttaattccgcttttgtcaatcagaataggaaaggtcagctgataatgatcagcaaatgatttcacagcctgtatatttttttcagaggatgtaaaattaacggctgctaccgcaatatcaggatattctttctgcagctcctgcatatcgggcatttccattcggcacggcttacaccacgtcgcccagaaattgaggagcactttttttcctttataatcagaaagggagatactttttcctgacaatgtatcaagtgtaaagtcaggggctttcatcccttcttctgtcccttctttcggacttttttgtacagaataaatgttccagcccgcatacactaacaacccgataagtaacattccgcccagccatttcgcaagcatctcaaggcctcccgcataaaaagagagaaagcagactgctttctctcctttgttcattctgctactgtttcattttatcgcgaagcaccatttgtaaaatgccgccgtggcgatagtaatcaatttccacttcactgtcaaaacggacaacaacttcaaatgtttttaccgtaccgtcttcactgattgctctgacagtcagcaagtcgcgcggacgtacagattcatcaacatccacctcgatgacttccttaccggttaagccgagtgtatccgcgttttcaccctgtttgaactgaagcggcagcacacccatgaagacgaggttgcttctgtgaattctttcaaagctttcggcaatgactgttctgatgccgagcaggtttgttccttttgcagcccagtcacgtgaagagcccattccgtaatcttttccggccaggacgacaagacccgttttatcttctttataccgcatgcaggcatcataaatagatgtcactttcccggtaggccaatgtgttgtgtatccgccttctgtacccggtgcgatttggtttttaatgcggatattggcgaatgttcctctcatcatgacttcatggtttccgcggcgtgagccgtaagagttaaagtcacgaggagaaacgcctttttcctgcaggtatttgcccgccggtgtgtcttttccgatcgctccggccggagaaatgtggtcagtcgtcacagaatcgccgaatttgccgacaacgcgaagtcctcttaaaggctcaacttttcccggctctacagacatttcctcaaagaacggcgggttttgaatgtaagtggaatcctgatcccacttgtacagcgcttcatccgtcgtttcgatttcgttccagcgctggttgtcgtcaaataccgtttcatactctttgcggaataattccggcgtaacagtctgtttgacgagagaattgatttcatccatggacggccagatgtcatcgaaataaacattttgtccgtcatttccgacaccgatcggatccgttttcaggttgatattcacagtgcctgctaatgcgtatgcgacaacaagcggaggtgacgcaaggtagtttcctttgacaagcggatggatccggccttcaaagtttctgttacctgacaagacagaagtgatcaagagatcatttttagcaaccgcttcttcaatctctggagaaagcgggccggagttcccgatacatgtcgtacagccataccctacgaggttaaagccgagctccttcatgtaaggaagcaggcctgagttgactaagtatccagtaacaaccttagaccccggtgcaagtgatgttttaacataattcggcactttcaagcctaattctaccgcttttttggctaccaatccggcaccgattaatacataagggtttgatgtattcgtacagcttgtaatagcggcgattgcaatcgcccctgttttcataaccgcatcttcgccgctgttaagtttaaatgaaatttctttgttctcttcagcagcatccgctccgaatccttggttgccggccgggctgacaagatgttttttaaacgtttcctgcataacggaaagcgggattaaatcctgcggacgtttcggtcctgataggttcgcttcaatttttgacagatcaatttccacaacgtctgtaaaaatcggctcttccgcgtcaggcgtatagaataaaccgttgttgcggcagtatgcttccacaatatcgatctgctcttcttcacggccggtcagacgcaggtaagaaagtgcttcctcgtcaaccgggaagaatccgcaagtcgctccgtattccggcgccatattggcaatagtcgcccgatccgcaagcggaagctcagcaacaccaggaccgaagaattcaacaaatttattgactacacctttttcgcgcagcacttgagtgactttcagcgccaagtcagtcgccgtcgttccgttaggcaattttccgacaagtttcgcgccgatgacctcaggaacagggaaatatgaaggctggccgagcattcccgcttccgcctcaataccgccgacaccccagccgaggacgccgattccgttaatcattgttgtatgggaatctgttcccaccaatgtatcaggatatgtcacaagttctccgtcttcctctttcgtatgaacgacacttgccaaaaactcaaggtttacctggtgaacgatacctgttgcaggcggaacggcctgataattgttaaacgctttctttgcccagcttaaaaatttataacgttctgcatttctttcgaattctaagtccatattaatggctaacgcgtcttccgtaccggctttgtcgacttgtacggagtggtcaatgaccaggtcaaccggaatttcaggattgattttatcagggtctccgccgacagaagccatggcttttcttaaagatgccaggtcaactacggccggaacgccggtaaagtcctgtagaataacccgtgaaggtttaaacggcacatcgatatcttttaattcagcagtaccccatcttgctaaattttcaacatgttcttttgtaatgacgcgtccgtctacctgacgcaaaacggattccaaaagaaccttaatagaataaggaagttttgaaacattgccgacccctgcgtcttccaatgcttttaatgaatagtagttgtatgttttcccatttgaagaaaatgtttttcttgcttggaaaacgtcttgtgttgcgactttttgctgatttgtcatttcccaaaatcccccttcaatgatcaagatcgtcctttagatgaatgttcacattccatcacaattttctcacaatttcatcttagtataaaatcatacataagtaaatatcaatgtttttattaaatacaataagatcgtcttatcagcatgattttcggtaaattttgtccgattttccgcctcatacaacgggctgtaaagagccatattaatgttgaggtgatgatcatggtaaaacggaaagccaatcatgtcattaacggcatgaatgatgcgaaaagccaaggcaaaggcgcgggttatatagaaaatgaccagctcgtcctgacagaagaagaacggcagaacaataaaaaaagaaaaacaaaccaatagccggaacaccttaaaaaggaggctttaacatgacaaataaaaatacgagtaaagatatgcataaaaatgctccgaagggccataaccccggccagccggaaccgctgagcggaagcaaaaaagtgaaaaaccgcaaccatacaagacaaaaacataatacaagccacgatatgtaaaacagaccccgtgtctgtttttttgtgccattcacccattcaaagcttctgcatacgttatagcaaggctttttaatatggaggaatgcttccatgaatcactcaaaaaacgctgaagaatttgatgatacggaagaatggctgcggcagttttacgaggacccgtatgcttggtatgacgagacgctgccgatcgatctatatgaaacaagccgtcaatatatcattgaagccgacctgacggcgctgaagcaggtgcaagcgataaccgtcactctttcggggaatgagtttatgctctctgttaaaacgcttgaacggacgttaaacaaacaaatgatgcttcctttttatctgaatgacaaacatattttcactgatttcaccaaccatattctgaccgtctccatgaacaaggagccaaatgagactcctgcctctttttcctttcaatttcctctataacataaaaaagccgctttcatccctcaatggaagcggcttttttgtccggtcatatcagtcatataccctcaaagtgaaactcccatggccaaatagcagaatcactatacgatagaatatgttctaccaaccggaatgactggacatctatcattttttctattctttttttcatgtgttcttctattctgtcttcgtttacaatatggttaaagtaaggaggagatagaacaatgctggaaggctggtttatgtggtttattttattttgggtcatcgtgatgatcggattgctgtctatcggcgggttttttatgtttcgaaaatttttaaaacgcttaccgaaagaagacggccggtcagaactggattggcaggactattatattgaaaaaagcaggcacttatggaatgagggtgacaaggcgtttttggatgaattggtcgcccccgtgccggagctctttcgggatgtagccaaagcgaaaatcgccggaaaaatcggtgaactttccttagcggaggaagctgaacaaataaaccgtgatttaatcatcaggggttacatactggccactcctaagcgtgatcatcaatttttaaaaaagcatctccgtgaaaaacagattgatcttactccttatcaagccctgctcaaataaaaaacctttccggcgcacggaaaggttttaattcatctgaatatcagcggtcttcagttcattcgaaagtttgcggtaagacaaaaacatcgcgatgcgccacgggacaatcattccgaaagccagaatccaaaacattccgcttaaagctccgtaatcaaccgtcgtgctcaaaatggatttcatagcgattctgataaccaagagaccaatcaggataaacacaaacgcttttgaccgttttaaatagatttcattatttttaatctcaaatttagatgttttaatcagaaaaatagagaagatcacgcccagcgtaatggcctccaaaaattcttcgcccgtcactctgaaaatcggaaaaaggaacataagcgctcccgtactcatgaaaatcggcgggagaattatttttttaggtgaagcgggcttgtcggaggatttaatcctgacgatcatcacggaaattgccatggccgctgcaataacggatgaaattataatcatcatctttatcattcctttgcttgcacggagtttgatactatatactatactccaaaaacataaaaaaaaccaatttgaaaagagaacacgtttacgttcccgttacccggcctacggcctccagcactttagatgcttcaaacggtttaacgataaagtctttagcgcctaattcaatcgcttccagaacgatccgctgctgccgcatggcggtgcacatgatgatccgggctttcgggtcaaaagctaaaatatcctgcagggcctgtataccgtttttgaccggcatggtaatatccattgtcaccaggtcgggacggattttttgatatactgccagagcttcctcaccgtcagccgcttccccggccactgtgtaattcgccgattccagaatctctctgattttcaccctcatgaacttggcgtcatctacaactaaaactcgtgtcatattcccctccacatatttaacattaactagtcttattgtaccaaaaacaaaagggtatataatagttcaaaagttattaatccgttacagacccgtaaatcctccgaaaagatttgacagaacgatcagaatgtagctcatccagttaaaaaacagcataactccgatcagaatcataagaatgccgccgattttcatgataagcagctgatgcttgcgaatccaattcattctggtaataaaaaatgaaagaacaagaaaaggaatcgcaaatccgagaacatataaaaacatatacggcactgctgaagaaggatttgtattggccagcgaaaacacggctcctaaaataggcccgctgcacggcgaccagccggctgcaaacgcaagaccgatcagaaccgaaccgataaacccctccggacggcgcttaaagtgaatgcgccgctctttcatcatgaatttcggctgaaacacaccggcagtaatcagcccgaaaaggatcagcatgatagcgccaaactggcggatcgcttcatgatattgggtaaaaaaactgccgataaacgaagttccatatcccaatgcgataaaaatcacggagaaaccaagcaaaaaacaaagtgtatgcacaaggccgcgcttttgcagcatcaccttttctgttttcacctcgtccatactgacaccagttatgtaagataaaaaggcggggtacaacggcagacagcatggagaaatgaaagacagaaatccggccccaaacgtcagaaagtaattaaaactcacgatgacacactcccttcgagttatgacaaaatcatttcatttttttaacactttcccgagaaggattactttttatagaaaaagcttatataatttaatttgacatcgagatattatactccttcttatttgaaaaacagtataaatgtggatataataatagcgactcaggtgaaagatttatgtatgaaaggatatatccctgtgattagagagcatctattaaatgaaattgaaaaaaaacgggcagagctgcttaaaatcgtcatgacaaacggaatgacatcaaacattacgatagaactcagccaggagcttgaccaccttctcatacaataccaaaaagaactgcacaccggcagttggggtgaaacatgacgccaaaataaaaaaccctctccgggttttttatttttataaccatgtatctctatatcataatctgtacgtattatttcgcttgattattcatggctttcatcatttgattaattttcttttgagaaggtttcattcccatttgcatcatcatcatgcgtaacatttgttcattaataggcggattctttttcaaatagctcatcatatatttacgagcaataaaaaacccgagtgcaacacctatgagcaatgcgacaacgcccactaggatgccaacccataaagtcattttatttcctccttcatgttgtctagtttaaagtgtactaaaccaaaggctattatacaacatttacatctctttttcctcgtttttagacaaaatttctttctctgaccggatttaaccacccgtagcgccgtgtcttgaaatccattgcaagaaaacaggggctgattttacgcagaatctcaaagaaaatcgtttccgcctcataatctcccgaagccgcaatctcaattaaactgtctttcatcatgaaggtggcgcggcccttttctccgggcagtgtaagccggtaaatggaatccaaacggctgtaactcattcggtttaaatgcagctggagacgctgatgcatatgtatcaccggaatcggttccgttatatattgaacttgcttttctgtcaattgatattcatggggtgtcaggtctgtccaatgatagtctcgaaacaactcaaacatagccgtttcccgcccgaagtagtggttcgcaaactcatcctttatcaggtgcgtatagtaatgacgttccatttcctcatccccttttacagcgcttcgttattgctttctattatacaaaaggagaaaagaaagaattgtctattactgttacgccgccccttctatttttgtcgcataaacaggaaaaagaggatgatttgactcatcctcttttgtctcgttatttgtttaaaagttttttcacgcggtcaaccacgttttctgcagtaaacccgtattctttcataattgtttctcccggagctgaagcaccgaaacggtcaattgcgagaacgtctccttcaagaccggtaaatttaccccatccgaagcttgaacccatttcgatcgcaagacgtttcgtcacattcggaggaagcacgctgtttttgtactcggccgattgtttttcaaagcggtcccagctcggcatgctgactacagatacgtgaatgttttcttcagccagtttcgcttgagcttcgatcgcaagtccgacttcagaacctgtcgctaaaagaagagcggccggtgattccgtttgggcttttgaaacgatataagcccctttttccacgcccgcatacgcttcttcagcctgctgatcaatcgtcggcaggttttggcgtgtcaatacaagagctgtcggatgatcttggctttgaacggcaaccttccatgcagctgcggtttcatttccgtcagcaggtctgatcacagaaaggttaggaagtgcgcgtaaagaagcaagctgctcaatcggttcgtgagtcggcccgtcctctcctacggcaatactgtcatgcgtgaatacataagtgacgggaagacccatcaatgacgccagacgaatggcaggtcttaaataatcagagaacacaaagaatgtgccgccgaatacgcggaggccgccgtgaagcgccattccgtttaatgcagcgcccatcgcaaattcacggacaccgaaccagaagtttttcccggcgtagtctttggccgtgaagtctcctccatttttgattgtcgttttatttgaacccgcaaggtcagcagatccccccacaaagaaaggaattttcttggcgatcccgttcagcacctcacctgaagatgcgcgggaagcaaggctgctgcctttttcataaacgggaacttcctgatcccagtctttaggaagctcgcctttcattccgagtgacagctgttcagcaagctcaggatatttttctttataagccgcgaacagctcattccattcctgttcttttttcgagcctgcttcttttacagcttgattgaaatgcccgtatacttcttccggaacataaaaatcttcttcaaacgtccaagcatacgcttcttttgtcagcttgctctcttcttgtcctaacggagcgccgtgaacgccggatgtgcccgcgcggtttggagaaccgaaaccgatggtggttttcacttcgatcaatgtcggttttttatcattctggcgcgctttttcaattgcagccgtcaattcagcgatgttgtttccatcctcaacataaagaacttcccagttcattgcttcaaaacgctgctttacattttcagagaaagaacggtctaaatcgccgtctaaagaaatgtcattagaatcgtataatacgatcaggcggcctaattcaagatggcctgcaagagaagctgcttcggaagaaatgccttccattaaatcgccgtctccgcaaatactgtatgtataatgatcaactacgttgaatgaatcacggttatatgtctcagccagatggcgttctgcaattgccattcccactgccattgcaataccctgtccaagcggcccggtagttgcgtctactccggctgtatgcccgaactccggatgtcccggtgttttgcttccccattgacggaactgtttcaagtcttcaatgctgaggtcatatccgcttaaatgcagcatgctgtataaaagcattgaaccgtggcctgctgataaaacaaagcggtcgcggttaaaccagcccggattctgcgggtttacattcataaatttcgtccacagcgtgtatgccatcggagcggctcccatcggcatgcccggatgtccggaattcgctttttcaattgcgtctatagatagtgtacgaatggtggcaactgatttcttttcaattgtatccattataatccccttccttattgttgtaccttttcatcataaagcgatgctgactttttctcaactctttcagcttaaatttgagataaacttgttgaaaattgtcgtaaagcacatcctgatattagtatatacgaaaaaagaatacgtattgccgtattctttctgtttaatgaagattatttttctgttgttctctttttaatttttcaggggtgacatcgttgccttccggatcaatcacttttacgctctttaacgtatttttcattgaggagcggaatcctttcaaatactcctggcgaagcttttgctgttcagctttttcctcatccgttatcgtgtttgatttagctttttgagccaattcgttaattcttgcgattttttctttagaaatcataataagctcctttggtgcgtgttgattatatactactaaaacgcagtcttttttacaactgatgcgcgtcagctgccttctgtgtctgcgatatattcctgaaaccgccggtgaaccgtggctttggacacatcgtagccgaatccccttaaggtcgctgcgatttctgcaaaggtaagcttgttggctctcagcctgataatttccgaaaccggaacctcttttttttcttttccgctgttttcatgtctgtttttcagattccgttcaggtttgtagccgtttttcacggctcttttcattccccgccggattttcatattgtgaattttcctttgatattcctcaacaatactgacgatttcgagtaccatcgaatcagcttcggaaagctccagttcacctttatgagccgtcgtatatatttttacgttctccctgtaaatgcaatgcaaaagcgcaatcttggcgtttcctcttcccaatctcgtttcgtcctgcaccaatatcgcgtcaatatgtgattttttaatttcatcaagcatttcaaatactccgtcgcggtccatttcgtaaccgctggctttctcagaaatgactttcacgacttccatgccgtttgcagcagcaatctcactgagctcctcttcctgtctttttaatgacgtttgctgctgttctttgtttgtgcttacgcgggcataaatgagcgccttcatttctctctttcctctctaattgacaatggccagctgatatacggccggatgctttttcttaaccggaagaataagttcgtctccgggctttatatcagcagtttggagatgattattctccgtcacccactcaatgaaatcttctttattaatgtgtttcttttctgctacatgatccgcaagtgaccagagtgtatcgccgtcctgaacctttattttaacatattggctgagggactgatcatttcccgcacatgagacaagtaaaatagcggcacttaaaatcgcagtaaacagtccgacaaatataatagattctttcgccatgtaaacaacctccgataagaatgtttgttcgctttttataccttttagtatatacgaacaaacgtttctgtcaatcgtttttttcgaacctatgtttgtactgtcaggaaaatcatgctataatctacttaaaatcgacgttttgaggtgcgaaatatgacgaagctatcaaaaaggcagcttgatatcctgcgttttattaaagaagaggtaaaaacgaaaggatatccgccttctgtaagagagataggagaagcagtaggactggcttccagttcaaccgtgcacggccatttggcgcggctggagacaaaaggcctgatcagacgggacccaactaaaccgagggcgattgaggtattggatgaagaagaagtccacattccgaaaagccaggtcgtaaacgttccggtcatcgggaaagtgacggcgggtattccgattacggctgttgaaaatatcgacgagtattttccgcttcctgaccggatggttcctccgggcgaacatgtctttatgttagaaatcatgggagaaagtatgatcgacgccggcatttttgacaaagattacgtcattgtcaaacagcagaacacggccaataacggagaaatcgtcgtagctatgaccgaagatgatgaagcgacggtcaagcgcttctataaagaagacaattatgtgcggctgcagccggaaaatccgacgatggagccgattatcctgcaaaacgtaagcattttggggaaagttatcggcgtattcagagccgtacattaattctattaaacttcatttatcgtaaaaaaccccttacagaggggtttttttgcataaaaaaagcagattcgccctggcttaagaaacgaatctgctaaggaggaaaaacttacattcttattatccgacatcacacttttgaagtcaactaataatgtttccctcgagaaacttttcattcatttttcaactttgtatatttgtgcgtgatgaatttacttttgtttatgttttctttgggcgggtgcattaaaatttatatatgaatatttagtacatagtacaataatttatatttaaatataaaaaaacccgctgcctttagcgagtatctattttcaatcaaaatgataatattctacaccgtaaaaccctttaatatagacggggccacagacgtttgaagaactttcaaccagaattctgtatttgtgatacggatcaattgattttttatcctgggcactgaggtttaaccagctgccgctgtagtttttagaacttaatgtataaaaattcccgttcagcgccatccgctggagtttcatgcttaaaccgcacgaagagttgttcattatggtgaacttatatcctaaaaagtaatcgtcggcagctacagcccccggattttcaatatgaaactcttttgcatttccctccaaagtgaagcttgtttttgatccgaattcagtggtagccgctttagctgagtgtattccgctaaaacataataaaaaaacagcaatacatatccagtattttttcatttgcatccccctttttacatattttaacttgtgaatcctgtgatgtctattcacattttattaaaacgtatgctttataaccactatataccagtttaaaaatttgcggattgcttacaatgaagactaaacgaaataacgaaggtggttcaaatgaaacacgtaattgctttcgcttctaaaacggcgctcacacttgctttactgtacattgttctggatcttatgtaccaagtaacctttttaaacgttctgtttattacagtgatcttaagtttaatcacttattttgcgggtgattgcatgattctgccgagaacaagcaatttcacagccgttgcagctgatttcgggatttcattcattatattatggatattccttatgaacattggcggatttaatgtctctcctgccgcggcatcggttatctctgcactttgcatttctgtttttgaggcattttttcaccggtatttgcagcaatatgtacttcccgaagattatcaggacacaacagagacggatagcacgctatggagctatcaaaccgaggcgtctgaagaattagtgccggaaaaagaccctcaggaaaaaacataaaaaggaggcaatcgcctccttctcattttatttttgcttctgatcgtccagcggcagctgcagcagtgagtctgtgcctgtcgctttcggcgtttttccgtcccatttttcaatccatttatatttgatcatctcatcggacattgatttctttatgatttcgttataatcagcgatcccttccgcttcaatttttttctttttcgcttcggcttcggctattttaatttcagtttgtgtccgttcaagttcctgtgaagacttcacccttgcatcgatagcttcctgtgtggctttatccggcttcggtacgccaagcgtcagatcatcaattaaaaatccaagactcttcatatcatcagcaaatctcttttgaacatcggcagcggcttctgcagatttttgcccgtatgtgtcaataaccgagtatttgctgattgattttcgcgccgcatcccacagccttgtttttaaatatgtattttcaatcgtttcaacgtctaccgctccgaatttgttaaacagatcgactactttatcaggctgcacgacatagttgtaagcgatatccatttctatatttttaccgtctgaggttgccacttttatattttcattattcactgtctgcatacgcaccggatattccgttactttattaaataatccgactaagtgccagccttggtccaatgtgtcggattttaccccgccattcggtgagtatacaaccccgacataaccgttcggtattttttcaatgaatagtgacgctgtaacgcccgcaattaaaagggctgcacctataatcacaccgccgataattttttttttgtttccgcgcttattttcgctcatgctgatcttcttcctcccatgactttttgaattttttggctccgcttcccacttgtttaaagattggactaagcatcagccataaaccgaatccgatgatgacaagaagaatgatagacccgatcatcactttcatttgcccacctcttttctttcatcctgtcaattatgtatacgatcttaagaacttaaagtttcataaatttcaaaagaaaaagccccgccgacaaaataggcgtgcttattaatatttgtcactgataaaatcagaaatcgtttttgtgaattggtaaaaggtcccgttttgtgtggatgctctgcttttcagcgtaaaagtgtcaaatagtgattttctgaagccggtgctcatttcgatttgaatactcaatccggatgaagattgattggcaaggttgttcggactgacgcctgcatatttatcatttatgccaagaagaacggcaggatacccgtgccgtttcagcacatcggtcaaaagttcggcccgttctctgtctgtaccgccgatttttatctttttatcgtcactgccgtaaccgtgcaatgaaatgacatgagagtgctctttcaccatttgcacggccttaggttcatcgaaatgcgaacttgtcaaatgcagagccgcattaccggctggttttaacccttcaaataaatataaactccggttttcggcaatttctctggctaactcactggtccccggctctatgcctccgccgtgtatagctaatatgaggacagaagggtcatgctctcgcgttgaaatggaaaaatcggaaggatcttcattcagctttaattcctcgaaactgccgtaaatatctgaagcggcatcagcccgaaagaacggcagaagcaaaaacggtaaaattaaaactaaaattccttttttggttattgatggcatttgtatgtttatgttacaatacaaatgcttcagcctttgaagcgaacggcagaacagggtgactttggacggtttcttctgctctgcctctttgccagctgctttacggtctattcttctaaccctttttgccataacatcatcctttcttttgtttacacttttgtcacaatattatatacgttggacaaaacctccgttcatcttgaagaataaaaacatcaaaacaacttctatcctttaacctaaaaaagtctttctgttcaaagagacggaaggcttaaatgataaaaatgaaacccttctccagttttggaggagagtgaggactgcagggaaatcattttatcaatatgctgagctgggctggcgtccgggtcaaatatttgctccggcatagacggttacggagcggccggttatttcgaagtcaaattcgaacgtgacgtatgatttcccaattcaagaatccccgaaacaaattgaatgtaactgctgtttccataaaaaaaaagactgctgttaagcagtcttttttcgttttatttcgtacctgttgatcccagtccgccgcggtcattgttcccgagcttgtctacttcgatcagctccacttcaggcattttcttcatgattctgaattggcagatccgctcccccttggaaatgtcggtatcccgaagcgcgaatgcaggaaaaaaccagaagtcattgtcgcctttataagattcatcaatgactcccattgaatttgtctgaatgatagcgaaatgcttatatgtacttgaacgcggaacgacatgggcctcatatccttccggcagttccatcgcaactccaagcgggataagtttgaattcaccttttttgattgttatatcttcagctgcccgcaaatcaatccaatcgccctgttcaattttactgattctcgtttgcgtatcatctgaatatttaattttgatttgtaaagtcattttcgctgctccttttgcttccctatttcagtcgtattgatgaccaatccgtgccccattataccatttaactgataaaaatgttgattttggtgtatatgcagccgaagaggaagcactgcgaagccaatgagaataaacctaaaatgagggcccctcctatcagtttttcctccattttcacatgacagcttcaattacaataatacaaagctttatatccgttctttcaacagagcttttttaaaatttcaccttggtttcaaaaggaatttcgttctgaataaagaatttgaagaataagcgcttaaagggcgcacgactcttttctgtcccctgcctcaggcgcttatatcaaaagaaagaggtgtctttagaatggttcaatttaaaaactttcctgatccgtctttaaacgccccattgcagtctcgccctgcacagccctctgaattggagcatctcaaagcaaggatgcagaattttattaagcattccgcaacggatgataatcttgagatcgcagatgcccgggtgacggcggaaggaatggtcacctcacttttaaaagaacggcttgataccgaatacgaaatgcttatgaataaaatcacccgggaagtgaatgtggaggactacggagcggtccctgacggccgggacaatacggaagcttttcggagagcgatcgggaacggccgggtcaaagtaaatgttcccgcaggagaatttttggttcaagggataaaactcccctcatggactaccatttccggtgagggacaagggattaccgtgcttaagcttcatgaggacactcccgcattcgaatgggtcattactaacgatgattacgaaaatggaaaccgtaatatttttgtggaaaacatgactttagactggaatcctgatcgtcaatgcggggtcaggaaccccggaggacagttttccagctgtttaacgtttgctaatgtgcaatacggctggattaagaatgttgaaacggttaacgcgggtctccatggtattgatattacatctccgacttacgatcatttgcctgaaacagaatggacgaaagacggctgccgatatatatggattgataactgtgtggcatacggcgccggagacgacggcattaccacccattacagcgagtatattttcatttccaactgccattccggaaacccccgcggcacagagcatgctgagggcagcgcaaactcgaacggcattgaaattgacgacggctctaaacatgtatggcttttaaataactatacgagcggaaatatccgcgggattgaggtaaaggcgcacagcctgtggccggcttctcaaaatgttcatattatcggtcatgtttcgtatcgtgatgtacgttcatttgatattcgtcatatcggccatcatcaggcctcagaccccgaaagcacgacggcttatgatgttactttaaccgattgcaccgcgattgaaccggtgttcaatgctctctatgacggtgtgaccccgagggcgctggtcatctctgcttataaaaacgttaatgtaaacggattcacagctattggtgatccctcatacgactatggcgggaatccagtcgtggctcttcaataccgcagtcaaaatattacgatcaacggcattaaaatacgcggctttacacaagccggtgttgacatcaatatatccggcggatcaaataaaaccgattatgttaaaattttaaattttgatatatacaagtcatctcctaaaggcatctcaatcggcggaggccaatataacgtaaatattatgaacggtacgatgatcggagatggcggttccgtcggaattacgtcccctaacagtcaggccgtcattctcggggtgcaagcggaaggttacagcgcggccgcatctataaaaggacagacttatgagcagatccccgtcaatttaaagggaggcgcacagctcgcgaccagctccggttttgcattcaacccgacaagcgccgttattgcgggaacaggcgatattacggccagaggtgacagaaatgcgatcatcagctcttccggaggttcaagttctgaaggttcaagggcatttatcgccgcttcaaacaatgtccatattacgggcagcaaagtctccagaacgattctgtcatcagaaagcattacattggaagaaccatacacggttgccggagggcatcagtccatcaaatggaaacttgattcagcgggcggtcacggtacgttcgccggagctgtcacctcttccctgtcagggtacggagaatattttgaaagtgtaaccggccagacaattcccgccgggacgatcgtcacagtgaaaggcgaaaaaattgaatcggctcacgtcggagattacatgctcggcgtcatttcagaaacagccgcttttatctcaggagccgcaagcttcggatggcaaagccgctttttgacaaacgagttcggcggtttcatttacgaaaatgtgactgacgaggaaacaggagaaacggtacgcgtgccgaaacaaaacccagactgcagtccggctcttgaagctgactatgaagcacgcgcggccagagacgaatggcacattgtcggactcaacggccggcattacgtacgggtcgacggtacggtcagcccgggagattatatcacggctcataacggaatcgggactaaagccgcggaaggctggaaggtattgaaactgacggccttatacagttctgaaaaagggtacggcattgcaattgcggttatcaaatagggtctcaatatcaggatcatctcttctctattctatcgggcgggtatgatcctgttttttataccgaatgagatgcctctttttcagcataccgtttcatttgtccaagccatccatgctttctgtcatagaatactaccgtcagatgaaaaaaggaggaatatgagtatggatatgggtatggatatgggtatgggtatggatatggacatggatatgaacggacattatgatcaccacccaaagcagcctaaacaaaaaaagaagaaacaagataaaaagcatcttgattatgattacatcgttgtttataaaagaaaatgtaaaaaatgtaaaaaatgctactaacttgacatatcaacactttttacacccggtaaactccgggtgttttttctattatggcgtttctccgggctattttcacccaaaatccggtcatcctatcacaatacataaaaagactctattattttcttcccttttcgcctaatgaaaagtatttcatttacagaaaacaacacaaatggaatgacattacttttgagaaaatctactctttgcttggtcaatttttctgcgataccatgaatttgcaacaatttttaaaaatttcctcaggaggtcatagccattaaaaaatcgccagaacgatagtcggatcatgcttagctttatctctaacaattcctttcacagccagtgcctcagcagccagtcagtctaaacacgcaaacgcgcctcacgtttcacccgttgcaaatccgttagaaagtaaattatccaaaacagcagaccaaaacgtaaaagcagcaggtgttgatgccgggctgaacgtaaacgtagatgttctcggaatctcagatcgcattgctgaagcggttaagtaagatcaaaaccgaaccggctgggtaaaaaatgtcatggaaacaacattttacgcatcaggacagaagtacaacgtcatggtgttcaatttaaatcaagaatatgaagaccgctttaacggcgttcagttttacggatcagccgtttatgacggtattacttacggaatctgggtcttcgaagacgggtccttcgataacaaaggagacgggggctggatcaattgggcattcagagggtggttcgatcgtgataatcagcgtattgaattccacagaccttaatacggagaaaacttgcggcagcgcccgcaagttttttttaactggactgcacatttttcaccgttataacgactatacttgaaatgcgggctccgatcgcagccccggtaaagtctttcaaagtgagggtataccatgtcaaagtctttaaaaatagtgttgtggagcatattggtgttcatcatcttgttagtgattatcggaatcgtttcttacaatcaaactccgtctgcagaaagcacagcaaaaagaatgctttacagcgtctaatcaatgttaaatcttcatcggctttttttatttaccgcagaacacttgaagttcttctatttagatcgttaacgttcccattcggaatggagtatacgcgtgtatcatcaggcaatccgttttgatacatggttccgattatgcccttcgcatcttttttctcgattccccatcacattcccttttttcataatactgctcttgaaaccaaccaatcatttcttcagcctgttccgttgaatcaaaaggttccaatcctaatagcgtgttgcattttcatttttaaaaaaacaagccaactgcgcatcctcttcgcaacttctcaatgtatgagcctactcgtttctattacaggaagcagtacgatgcctccttttactcattttaacggatggtcatgtaaaggaaatatagactaaaaaaactttttttcaaaaagtaaactagcatccctatcaaacttttcatttcggcataatatgtattaatcctctttaggaggtgagattatatgggattctcaggtggttatggtagctcctttgcgttaatcgtggtgctattcattttattaatcatcgttggggcttctttcctcggcggttattaagaatcctcttacctccgcatccatgtcagcagcacctccatgatcgtacggcgccataaatgaaatgtttatggcgctctgctgtttttccccttttcattcacacattaaaactaaaaagatcggccgatgtatcaacatgcagccgatcagtaattcatatattattgtgtaaggtttacatcgatgacgttatagaaggcattggaagtatccgcaacgtcccatacccctaaaatgacatgatacccgcttcgatcagtcggcacaaaaatcttatgagtcagattcgtatctgccttggaaccgtcgtggtttaccgttccgattaattcgaattcatctcttgacaaaggtttattcggattccagtttttcttggtgatataatagtgccactttgatgtcgcatgaggggccgtgtagtaccaagtaaaggtgttaaaaccgccgcggatgttttgttttacccaataatctgcagtctgcttgtctaaaccgaagtcaatttgtcccgatcccccatttgcagacgcgattcttccatccggcggacctgcagccggaaatcctttcggcccttctacagactgaggattatcaatgacggagccatatttctgcgcagcggccgtccagcccaatgtttgtttctctaatgctcccatgtacgctctgctgacgggctcttttatatacccgtgtgcagatgcatcacttgaatagaaagcgcctccaataccaagagtaacagttaaaactgcagcttttactaaacctttcattactgcatcatcctccctcttttgttaataaaaacccttcagtgtatacacttcacgatggaggatgaaatgaccttccttttcttgataggaaaaagcaatgaggttggcgcttttccctttgttttttataatcataaagaaaaagccgggccgattctgttatcgaatccgcgattgaccggcccgccccttttgcgcagaacttcattcgctggatttgccggtttcctttcggataaccggtgctacttccgctgctaatcgttcgatgttttccgcggcttttttaaacggcatacctcctatatcgatttgcgcgagaaatcgctgatgtccgaataactcgtattgatgcatgattttttcaatgatctgctgtgagcttcccacaaataaagctgtttcttttccggacgcccgcgcaaaatcttccttcgttaaaggctcatcgatcccgtgatatgaatgaacgtgagaccagtaatttgaatgatacggataaaattcttgtattgcctgttcattcgtttttgaaatgaacatatgtccggttacggcaaccttcacattttccggaggatgaccggctttagaagccgcttcccggtatttgtcaacaagcggcttagatgacatcggatcaccgctcagtacagctaatgccaaccccgcacctgcacgcccggcccgttctgcgctttccggagtccccgaaacacctaaccatagcggaatgcttccgcgaaaaggccgaggagaaatttctgcctcgcgcagcggcggccggtaacgtcctttccaggtaaccgattcttccccggaatttaattttaaaaaaaggtcaatgtgttcttcaaacagttctttataatggcctacgtcataaccgaaaagaggaaacgagtctaaaaatgcgccccgtcccgcaatgatttccgcccggccgtctgaaatcagatcaagcgttgcaaaatcctcaaataaacggacgggatctgcggtggataatacagtcgtggcactggtcagcttaatattttcagtgatctgtgaaatcgctgataagatggccggcggcgaagataccgcataatcaagacgatgatgctcgcctacaccgaatacatcaagccctgcgtcgtcagccagtttcgccagcttcatcaattcatctatccgctgctttgcgctgactgttttccctgtcagaggatcgggatataattctgcaaatgaataaattccaatttccatacaatcacggtgttcagccctcacatttctctcctcctgcactgagtaaaaaagcttttatgttattctattcagccgttttacaaataggaattcgttcaaaataaatacagaaggtggtatgagagaaaaaaagtttctggcgtccttcaattctgcccattatactcatgcagccggactaggcaagaacaaagccggcacaagcggattcgaattcatgtgttcattttcagtccaattcaatccaatcgtgatattgatcataaagctttcgtattcttccggcatcaagagcaatgacttcacaccctctgtcatcatacagaaagaaaataatatcttttgtcatattcacaaagaaaacatcgggatacccaacggaacagcccccgaaccttggcttcagcggaaaatcttcgtggacggctgccttaagtaattgggggatacgcagatctttccgtttacataataaagaaaactgctgcatttcatattcttcttcgaccgggcatggacaggtcttcacttgaatccgatataaatcatccttacacttcagaaacggctgataaacctttaattttctcgcgtgattaccttgagttttgtgcttatacacgttggcaacaaggaacatgtcatcgctatgttcaaacatctcattgaaaaatgcggcggtttgatgatgaacaagctgaaaatactcaagattcaaagcaccgctttcattaaattgatacatattgccgccgagagaattcccacgtcccattgatgataaacgccggacactaattttaaagtcggaagcctttccttcagataatcatttattttcattcaaacatctcactttccttttcccgctccagaggcagaagaagccgaaaacattccgcttatttctttttcacccttgtaatattattcagattggaatacaatgaaatggaacactgtgaaccccattgatcagggtggatgctggtcacattcatcctgatcctttcttttacacaagatcgccccaactttgaacccctccgtttccaaccctattcattgatattacatatatttcaatggtattattttcttatacataagcatcaagaggtgtccgctttgaacaacatcagaagattgagagaatatttccggtctcaccgtaaaataggtctggctgcagacttgcttacggctgtattgcttatctcattatccattcttttttacggatgccggcagggagctgtcaatggtttctttatgtatgtcttagtaagtaattttatcggctccaatgcctcttttatcgacttcagcacatcgaggaaaaacagtcaaaaataaaggctctggtcaaaaagagggttataccgccctctttttattctttcagtcataccaatgcgttcttttcaggttgaatttttctgaataggactcatgatcggttttccatgctgcttcaacagtgatttcatgaccgattacttcatgttccggcatatattcaaacgtttgaatatggtcttctcccgttccgccgccttctaatttctctccggtgtattctgaaagatgatagtctttatcttcaccatatttccggccgtcaacaaataatgttaatctcttaatcaccgtgttcttttcattcactttattacctctgtaatacaaattcaagaaatagttagggccgatagaggtcttgcctgatttttcgattgacgcttcccacgtcttgctttggctatagccgatatatttaactttttctcctgaaattaaagaaaacagtgcaaatccggctgctattatgagaacagtgataataaccagcaattttttaatgactttacgttttttcatgacatcccgcctttatcatttagaacgtatgaatattagaattgttacatttaatttgaaagaataataaaaagggattctaattccaggaataaaaaaatactaagaagatcatattccccttagcttcacatcccagactgccatgcaataatgataaaagtcgtccaaaaagttgtgactaaaataagcataacggttacaatcattaaaatgagacaacttattgttagaattgagtctttgtttttgttaagaatcagagtaaccattgatcctgcagcaaatagatacgacaaaaccgcaccgacccaataccacagcatagagtcattgctccagtaagccattgactgcatataaatactgaatataaatcctgacaatgctaatagaaacgaaactaaatttgatttcaagttagagttcctttcttcataagttttatttttaggaacggtcatacatctgataacaccttttatgcgatatgcttcgccgctttgtctgcatattttaattcttatttcgtttttaaataagtttacgaaaaaagaaatcatataaagttcacctgaaacgccgatttaaaattaaatagatgttttataagcgttaattgcttgatttctcaaaagcatatttatcattcgcaaccattccaagattgtatgcttgtttgatgatatccagcacttgattatcagtttcagttacaactcgtccaccagttattctggatttccaataatcaaactggtgatttcattctgaacagcttttaacattttgagtatcaaccacttttccattctcgagcgcatcattgctgattcgattacttcccgctccttctgtcgttaaactgcaaaatgtccatcacattcatcctctctccaattttacaacgttgctataatgaatttcatgattttcccaaccttcaagcttaatctttttgatcgttactaatctaagtacttttttcaattccataatccattggtatgatcggtaacctaatgaagtatttaacttaaatacaaaaaaacctgctttttcagcaaggttttttcgacaaaggggagattatttccccacaaattctattaactatgtttttgttttaaccattctttctttagcaatgcgtattggtaagtgttttcatatttaggtgttccatcctcgtgtgcagtaaatgaaataaattcaagaaaataaccttctttacgcattcctaatctttcacataatttttgtgacctgcagttatcatcttcaacatatgcataaagccttcttgcttttttttgcataaagagatactcaaagaaagccttcgcactttcacttgcgtatcccttcccttcaaaacgggcattgaaattccaacaaacagaataggtatctggctcttcttttaaataaaatagttctccgactagatcattactgtcttttaaacaaactgcaatataagagtcatctcggcttcttttttgaacgtttacggcagcttcttctaacgtagacattctgtcatcaagaaagcaattcactctcggatgtgcagaatattccaacagaccttacgcatctctctcggtaaaatttcttaaaattaagcgaagggtttcaattttttgcatttgcagtctcctgtttcattgttatcgatctttgaaaagaacttcttcaacagatcttattcgtttgttgaagaacttatctcaatctatttttactataatgatggacgttatcatctttgtcaaaaacaataatcattcatttggcgcccgcatgtaaagtactgaacaattttcgtgaaaaaccctcagtatcgaatatagaaacgagcaatagtaattaaaacaaagttaagccattaaaagcttattgagtattttttcaaacttattcacgctcatcatctcatgagtgagaaatgtcccattataaaacacgctgaaagtcgtccaaactgccggggatttttgcgccatatcttttgacgttattcgccgggcctgaaaatgaagtcctttcttttcagtcagttcctttaaatcctttaacaatccgactgcaaatgggcattgggctgtataaaataccctcattattaacggaattacttttcacctgttttttaaatacaggaggatatgcatgtttattccacgtcagtgacatcaactgaaaatagggttctgcttcatcttgcacagcaaatcccatatgttcaaagaaatgcttatcacttaaataagggagttttttcttccccactatatgaactatcccatccataccgcgggattttgcatctgacacacatttttctaacaagtgtttcgcatgtccgttattcttatatttacctgagacccaaagacaattaataaacataaaatgaggtgcgcttaccggaacccacgcttcttctgcaggtaaatattcaataaaaacttttgcccgttcgtttaggcgatagaacaccaagccatcaatcatccgatctttgagccagctcttcttttcatttaccgcatcctcatattgtttcgcacctaatgcacagcaaatatgattgtcattaatattgtccctagtcaactcaatgtattccatttttcctcacccgctttcttttggaaacatcagctttacttgcagtgaacattgtaatttctcagaaatatagagtcccagaatcaatatatgaacgcagcaacaatgctcattatgtaataaatgaaacttctgaaaactgtgaaatcaattgacggattatctatgtgccagaacaagaacacggctaaaaaagcgactgctgtataaatgaaaagatgaaccaaactaaactttttaggcttctttcttagccatagttgcacaggaacagcaaacaaaaagtaagtaataaatgcataaaaagcaatgataactacagtaaccaatgcaaatggcacaaaacccgagtatacaaacatatatagcccgaagatcaaaccatacgacaaacttgaaaaagccaatgtgtaagtatagctttgacttttgctccaagacgctgcttccatatagttcacctgctttttataaaaatacatttctcatttttttcctattgtttaaaatcagtatatatccatcactttaaaagatctatgtttttttggcagatcatcaattcactatcttaatatccaaattttaattgccattaaaaaaggtcaaggaaataccttgactgtgtatcgctcaccaatctgcatccggctcatcatgttcgaatccgtaaaagcctttaatccacacatctccgcagccggctccttttgtgatcaataagtaatgatttctgtttgcatcaccattcaccttatcagccgcgctcaagttcaaatgattatccgtgaaattctttttactaagggtaaaatcatatcctgccagtgtaattctctgcagtgcaagtcaaatatcgacagaaagattacgaccacaaattcaaagcattctgtgcatttggagactaccccccccatttaaacaccattcggatgacaaatgcatagctccctcaacttttgtagagacacttgtccgcaaaaaaatgtaagggttttcaaaaggagagcagtgtgctaaattgtaagataagtaaaaattttctgccaatattcgaaaggggtgcatgatttgaaagcagtagtagcaacaaaagacaaaagtatagcgatcgtacaaaaagaattacgtcctttacgacatggtgaagccaaagttaaaatggaatactgtggtgtatgtcatactgacttgcatgttaaaaatgctgatttcggggatgttactggcgtcactctaggtcatgagggaataggcattgtaactgagatcggtgaaggtgtaacaagtttgaaaaagggcgaccgcgtctctattgcctggatgtttgaaagctgcggctgctgtgaatattgcctaactggccgtgaaaccttgtgccgcgatgtaaaaaatgccggctatacagttgacggcgcaatggctgaagaagcaatcgtagcggttgattatgcaataaaggtgccggaaaatttagatcctgcagcagcaagcagcattacttgtgcaggtgtaacaacttataaagccgttaaagtcagtgaaattaagccaggtcaatggatcggtgtatttggagtcggcggtttaggcaacttggctgttcaatatgcaaaaaatgtctttaacgctaaagtgattgcgttcgacattagcgacgaaaaattgaattttgctaagagcttaggcgctgacgcggttgtaaacagtttaaacgaagaccccgtcgctaaagcaaaagaagtgactaacgatttagggcttgatgctgtggtcatcacggctgtctctaaaacccctttcaatcaagcgattgatgttgtaaaagcaggagctcgcgtagtcgctgtcggtttaccggtggacaaaatggatttagatattccccgtctcgtgttagatggaattcaggttgtaggttcattagtaggtaccagagaagacctgaaggaagcttttcaatttgctgcagacggtaaagttgtacctaaagtgacaaaacgcccgattgaagatgtgaatgatatttttgaagaaatggagcaaggtaaagtgaccggccgcatggttatcgattttacttcctaatcattaaggctgccgggaatgatacggcagcctttgatctcgattcttgctcggcgccccacccagactgaatgagactttgtcatttagttcagaaaagaagctctacagatcattcggcggttatgcattttgcaagtactctctgaactaatcctgataccaatataatgcaaggtcattcattgccgaagcgtagccctgctgtcttaacatagttgttatgctgccctgatgataagttccgtgattggcaacatggaataaaatttctgagtaagcagtttctctgtaacctaaccaagggttatttaagttcattttttgttctacatcggtttggctattcatccattcttcaaactgtgaagccagttcttcataagacgccgcaaattcatctgatattcaataaaacggctgttgaacctttgctatgtatacagcttcatcttcacaggcccaatttaatctgcataatagttcactgaatctttcaacaattttagataaacatcttctttttatagagatgttcgttcaatcgacatccttgtgatatatatggtaaaatttatagaaacaaaggagtgttgttacatatgagtcttatcattttagcatccatgcttttatggggtgcagtgatccacgagctaaacaaaccttcaaaaaagcaaagtaaacgaaaaatgatccctttggtatccctcagttctttatctactttaatcatcacaatttcgcttttttctaatttaattggttgatatttgttatgaggaaacccgccagaggttcctcataacactaaaaacctactcactgcactttttacagcagaccttatcagagtgtttgcttaacactttatccattctccccacaggcatcttcttctcactcggaagtgtaagataagctgttatctcatcccctgattttattgtttttccgcagatagagcattttaactcagtattaaagaaattttttaatcccattcagaagcctccttacttacctttataaagtaatacgttaatgctttataaaagtttcaggttaaagaaatattccttgcccgggaatatacttcgtttcagttgatccgcagccgtcccggtcatcgttatacctcactcaatcaggcaacttcttccttatatcctctacgacattaaatgcggggaaaacgttcattcaagaattcagcgttaaccaaaaaggagaatacatcctgaaatatgatagcggcaccggtgatagtgtcaatggtttctttagatctgttgagatctaaattccgttaggaaagtcggcagttttgccgactttcttttccaagcattctgcaggaataaaggtgaagtgtcgaataaacatatgacctttttgaaacggaaactttatcggcatcacaaacccgcaagcagcctccttgtatcgtaccttccgtccctttgtgatttgttttgatttgtcgtatactgcgcttgcccgggaaatgatgaatattttcgttaactataatttccctgtacctcttcgtatgtggctctgcatgatgaagtaacttcatggctcaccactttcatacacagttttattgcatgtttagccatatccctcctctttaaacagcaaaccgtcccatccatttctctctttcagttaacctcccattattttattgttttagaagctcttcattttagacataacattcattttttcttatttagacttaaatctatgtcgaattttatcgtccggcatattatgtactatcctaacaacaggaggtggcaataatatggggaactacggtggaaattatggcggaagctctttcgtattgatcgttgtgctgttcattttgttaatcattgtaggtgctgcattccttttctagcacattgacgatttatattcgtctcccaaacattgcatcccttagttcggacagacgccataagaagttttatggcgtttttactttttaaaaaaaccaatctgagataaacattttttatttttactctggtaagcgggagagtttcctcccctgcctgcgccaatattgccgctatgaagaatgaggcgaacaatccaaaaggtgttgtgatccattctttaaaaacgattccgaaaatcaacaattcgcaagcagttccatataaaatagctaaacctgtgattgcccattggcttatattcttatcgcctaaacaacctgatacatatccagtccaaccactcatcatgtttgatgatgggcccgttgtatcttctgcagacttttctctttcaaagacaccagacttatcttcatctttaacgccattaacccaataggtcattttgttttgaataaagacttgttcatgaacatagctcctaaataattgttactaaggcgtttttaattcatcggattacagatgttgtgaacttaaaaaggatattactcaccttcataaaaagatttagtcactgaagggctcacccacaaaatgcggtgttcacacattgagtcattttcacataaaaaaaccggattcctcctttaagaggttccggtcttttttagttaaaatgcgggaaatatctggtgacgtgctgcacacccccgctattataatatttcaatagagccttctgttccatgaacgcgtattcgctgcccatcttttatcaattgggttgcattttcaactccgacaactgcaggtaagccgtattcacgcgcgataaccgctccgtgggtcatcagtccgccaacttcagtgaccaggccttttatggatacaaacaatggtgtccagctgggatcagtataggaggtaactaatatatccccatcttccaaatcggcatcttccatgtttaaaataacccgtgcccgcccctctatgactcccgaggaaacgggcagccctgcaatcgctccggccgggagattttctcgtttgtactcgcctgtaacgatttcaccgtcagatgtgataacacgcggcggagatagtttttcatatacttggtactcgccttttcgtgtgctgatgatttggtaatccaatttatgtgtgcgtacgacttcctgaagttcttcaaaagtgagatagtatatgtcctctttttcatgaataacgcccgcttttgcgagttgttcggcttctttcagtaaagcctgcttataaacgaagtagcggctgatcatgccgtattttggatattctctgaacccgctgaagttccggatgatgcggatcattcgtttggtttctttggctttttgttcaccatccggtaattgcttcaatcggtctaataactcttgttctttcttcaacgcctcccgccgcccttgctcaaatttccgctggctggcatttggctcaaagtttttgagattattaagaatcatagggacaagtgcagttggtttttcgctccatcgagttcttgtcatatcaatttctccggcacatcgcattccgtacttgttgagataagcatagatagcgtcacgggtttcccgcccgccttcaaacgtcaccagcccatccaaaaagtgatcatcttttacattctctaaataggcaattacttctggataagggcggatcacatcggcgacgtccaatagcgcaagccccatttctgaagtaatattatggggtacagattgagaaagcgtatctgctgcgtttttttcacctaaccactcgttcattttttcgttaatccatgatgaagcatccattgcagttcgaatcaacaccgaactttttgggttaaatagaatcttctttaattccttgatatcttccaaaataaaacgaaataaatcagatcctgatttcgtctggatgttttgttttaactcttctatcgatgcttgactgctcttaatcaaatcagaaacaattgccggatcgttttcagcttgttccggcatatctgcattgcctttgccgggaatcggcgccgttttatcaggtatcggcttaatgaaatcatctcgctctattatggtcataagtgcgtcttttaagagcggatcgtgctgccccatgccttttaagaaaacttctctgacattaggggatgccagttgatgtgtgacatcaacgaatagccttccgccggctttacgcatgggtgcagcagtcgtcaacagaaaaaaagacaatccaaggggttttatgggatccgtcatcatttgctgatgaccaacagagatatagacgtgattttcttgatcgttcgcttcaggaacgggatataacgttgtgatcggacggctttggacaatataaaaagtatcgcggtccaaacaccattcgatatcttgcggctggccgaaatgagcttcgatctgtctcccgatacgtgccagctgtaaaatttgttcatcagtcagtgtttgaatcttttgctgatcaagagcgatctcctgtgtttctgttccgccttcttttcgtccatagatagccaattttttagtttctattctcttatcgacgatttgcccgtcctgtactttataacaatcggcagagactaagccggagaccagtgcttcaccaagtccaaaaccggcatcgatggatagcagctttcggtttccggtcatcggatcagcggtaaataaaattcccgaagcctgagggaacaccatcctttggatgataacggataaataaacttggctgtgttcaaacccatttttcatacggtaaatgacagcgcgatccgtaaatagggacgcccaacatttactgatatgctgcaagatcgtatctaagccggtaatatttaaataggtgtcttgttgaccggcaaaagaggcatgcggtaaatcctcagctgtcgcactggaacgtacggcataggcatgttcttcgccgaaccgggagagatggcaagcaactgctttgactacatctgaaggaatttctgcttccataatggtttgccggatttttttgctgacatcaccaatttgatcccgattctccactttcagcatggtcagttgatccaacagcgcttgtaacgtttcgttttgttcaatggctttttgatatcctgcggttgtgacacaaaatccttccggtacttgtattccttgaatttttgataattcccctaaatgtaacccttttcctccaacgagcaaaggctgtgttttttcaatttcgtgaatgccgagaaccaaagaactcattctatatctccccttcaaaaaaatttgacaagagcttttcagcatgatataatcataatataagatggatatctatgacttttcacaaagaaagcgcgcgtgttctgattatatcaccgtgtctgtttttgtgcaatataaaaagaacctggccaatttggcgaggttctttcttcatttttgtcgaaagctctttaaagctgtattgagatcttttgtgtgaacgtaaatgttcttatacaactcgaatagtgttttatatttttgaacattttgttcttttggataaaatgcagctgcttcatgaatgaactgctctgcacattcttcaagagagtcaaaccacccgcttccgaaggcagctaacatcgcagcccccatggcgggaccttgttcattctctaacttaacaaccctcgtattgaaaatatcagcctgcatttgaagccacgtttcatttttagctcccccgccaatagagacaaccgtatcaactgattttcccgcttcgcggaatagctcaattgattcatataaagagaatgtgatgccttccattatcgccctcaaaaagtgctctcttttatgggctccgtccattccgatcaagcttccccgaatagatgaatcagcatgcggcgttctttcaccgactaagtaaggagtgtacagcagtccatttgctcctatcggaacagattccaccccccgcaataattgttcaaacgattcgttcggcgcaaacgttcttttgaaccagtctaagctgtatccagcagcgagcgtgactcccatcgtataaaaagaatccttctttccatgattaaaaaagtgcactttccctttaaagtccctttctttgtcttcttcacaggaaagtatgactcctgacgtcccgatactgcataatgtttttccggaagaaagaataccggctccgacagcaccgcaagcattgtctgctcccccggcgtacacttttgttttttccaacagcccagtctccgccgcaacgctcggaagcagtgatcctacacagtcatgggattcaacaagcggaggacaaatttccgctgaaataccaaattgattgcaaatctcatcgctccactctttgcgggtcatatgtaaaagtaacgttcccgccgcatcggagtattcagtgtgaatggcgccagtcatgcggaatctcacatagtctttcggaagcaaaaaaacagcggttttgttaaaaagttcaggctcatgtgccttcacccataacattttaggtaatgtaaacccttcaaggacacggttttttgtgatatcaagcagatgatcgccaaatgtctcggtcatcctgctacattgaggcgtcgttctggtatcattccaaagaatcgcatgacgcaacacccgccgatcttggtcaagcagtactaacccatgcatttgtcctgaatagctaatcccgtcaatatccccggcttgaacgttggatatcgaaatcaattcagccaatgcttcaattgtttgctgcacccagtcttcaggattttgctcactatatcccgccttctcttggatgagcgggtaacttttggacgtttctgcacaaaccttgccgttttgattgactaaaatggttttaacggcactcgtaccaagatctattccaatgacatacttcattttttcactccttcctctctaaatagatccccattgaattgacccgccataacagtaacttcatgacgggccattccgggaacttggctgcctgcatctttttacagcgggatctggagcttcttttttcatttgttatacctgtaaaatgtattgatttaatatcgcttttaaccgctcctgtctccctgattcgtttttaattggctgattgttcagcgcatattgctcaagtgttttaaaatcagctcttccttctgcaatttcaagaccaatcccttcagtaaagctgcggtaacggtgttgaatcacatcttcaaacacacgatcttcgattaatttgtgggcggctttcaaccctcttgcaaatgtatccatccctgcaacatgggcatatagtaaatcatcaggctcaaaagaagatctcctgacctttgcgtcaaagtttaatcctccgcttccaagaccgccattttgcagaatttcgtacattgctaatgtcgcagaatataaatctgtcggaaattcatctgtgtcccagcctaaaagcggatcaccctgattcgcgtcaacagagccaagaaggccatgcactctcgccatgcgtaattcatgttcgaatgtatgcccggctaatgtggcatgattggcttcgagatttaatttaaaatgattgtctaagccatattgctttaaaaaggcaatggttgttgctgcgtccgtatcatattgatgggtggtcggctcttttggttttggttcaatcaaaaactgccctgtatacccgatttccttcgcataatccactgccatatgcataaatctggccatattatcaagctcaaattttaaatcggtatttaacaaagtttcgtacccttcacgtccgccccaaaatacatagttctcggcgccaagctcttttgctgtttctaatcctttttttacttgggctgcggcatacgcaaatacatctgcattacaagaagtcgccgcaccatggacgaaacggggattcgtaaacatgtttgcagtattccataatagcttaacgccgctggttctcatgtagtcttttatcatgtccacgattatatccagattttgatttgtctcttttaacgtacttccttccggtgcgatatcccggtcatgaaaagcaaaaaatggcgcatccagtttttcaaacagctcaaatgctgcatctaccctcgctctcgccagatccaagcctttatagtaatcccacggtctctgcatcgtagctgcgccaaaaatgtctgtgccgtcagcggtaaatgtatgccaataggcaatagaaaatcgcaaatgctctttcatcgtttttccgccaattacttcttgagaattatagtatttaaatgctaaaggattcgtggattctttcccttcgtaaatcactttgtttgcgctttcaaaatagttgaccgaaccggaatgagagtgagccatgtgtgatttcccccttaaaaataaattctaaacatgatcattcaaatacaaatgcttttatgtcatgttgcacattagtttgttgaccaaacaaactaacttattttcatcttatataacctcatcagtattttcaatattttttttagttttttacgaacacattagatataataaaggttggattcgctatgtactgcgtttcgcacgataacagagaacgttcaacttaatttaaagattatacaaatggagtggatgaagtggatatcgctgatcaagcctttgtcaaaaaagttaaccaaaagttattactaaacgaaatacttaagaattctcctatttcaagagcaaaattatctgaaatgaccggattaaataaatcaactgtttcgtcacaggtaaacacattaatgaaagaaaacctcgtatttgaaatcggtcagggacaatcaagcggaggcagaagacctgttatgcttgtttttaataaaaaagcaggatactccgtaggaatagatgttggcgtggattatgttaatggcattttaacagatcttgaagggacgatcgtccttgatcaacaccatcatttggaatgcaattctccagaaatcactaaagatattttaattgagatgattcatcactttattgcaaacatgccgcaatctccatacgctcttattggtatagggatatgcgcgcccgggctgattgacaaaaatcaaaaaattgttttcgctccgaacgccaactggagagatattgacttaaaatctttcatccaaaagaagttcaatgtgcccgtttttattgaaaatgaggcaaatgccggcgcatacggagaaaaagtatttggagctgcaaaaaatcacgataacatcatttatgcaagtatcggtacaggaatagggatcggcgttatgatcaacaatcatttatatagaggggttggcggattctctggagaaatgggacatatgacaatagactttaagggtcctaaatgcagctgcggaaaccgaggctgctgggaattgtatgcttcagagaaggctttattaacatctcttcagacgaaagagaaaaaagtgtccagccaagatatcatagaccttgcccatctgaatgatgttggaactttacaggcattacagaattttggtttctatttaggaataggcctgaccaatattttaaatacatttaatccgcaagccatcattttaagaaacagcatcattgaatcgcatcctatggttttacattcaattaaaagcgaagtgtcatccagggtttattcccaactagacaatagctatgaattattaccatctatcttaggaaaaaatgcccctgctctaggaatgtcctctattgttattgatcattttctcgacatggttcataactgaatgtacatacttctatgttttacgctcatctttaaagatgggtttttttattctaggagtatttctgaatcaatactgacataggcaccttctaatatgaaaaaggagttctaaaatagaaatctcctttttcatgtgctaattatttttctttataacgaaaatatctgaagtcggccggaatatgatgaccgctcgtatcttggcattgcatccctacaaaagctcctgtaaagaatcccccgccgcggatgtaatcatctgataattttttcgattctaatgcaatgtcgattttgtgccaatcttctttgttaaatgaatacaaataataatatttttcgttttcaatattcacttttaaatagacatacttgacttcacgaggaatcacaattttattttttaacggttgtgaaaaagaaaagttatcacatatcgttaattcaagaatacggccaagttcttcatcatacgtgacttgaagagccgtccagttctctgtattgtaatagttcaccaaaccagcggcttgctgaaaattttccggataaaacgcaacagccgtttccgcttcaaaatggaggctttgccagcgtctggctacaaatgcctgagtaaatgtcgaagttaaggattcatggccatataatcgtaaatgatttggcgcttgagttaatgaacctaatttctccgtaaacgggattcttaacgtttgaaaattaatatttaatgttgcatcctcaaattcatcaacttccggataggtttcttcaaacattgtttctggtatagaaggcgcatccacttccaagctcccttcttttccgccttctacataaggccagccatctttccaatagagcttttgaatagctgtttctctgcccagaggacaatatcctctctgctgaaaaattgaatcatcgtccggatgaatgggacgtcccgttaaatgagctaaataccactcacctgtatgtgtttgtacaatggatgcatgtccgcatttttgcagcggattttccggcgcatgccatgacgttaagattggattatcaggatgtacttcatatgggccttcaatatttgcagaacgggcaattgtagcagcatgttcgaaccgtgttcctccttctgcggttaataaataataatagttcccgatacggtaaaggtgcggcgcttctgtcagctttctttcagttcctttaaaaatcactttcggtttaccgattagtttttgctccttatcagaatattcctgcatgacaatgcctccaaaggagtgccgatcaatacgctgatcccataacatatttaataaatattttttcccatccgtatcatggaacaaagaagcatcaaaacccgagctgtttaatgtgatcggctccctccaatcaccatcaatcgtgtcacaagtcactaaataattgtggcaatctttccaggcgccatctacaaccttaacatccgtatagatcagccaaaactttccgtcgctgtaacttaaacatggcgcccagaccccgcctgaattaggatttcctttcatgtctaattgcgaaactctctgtaatggatgtgcaactaagtgccaattgactaaatcttttgagtggtgtatctggactcccggaaaccactcaaatgtagatacagcgatataataatcctctccaaccctgcaaatactcggatcggggttgaatcctttaagtactggattgatgatcttcattttgaactcctcctcagctattttctgttgactcatcatgttttaagctttgaaatcgtcaatatgatccaaataaactttgtctctattctctaattctcgaaccatgcttttatattttttctcatctaagttatagaaattaatatcaatcatggccagaaccagtaagaacacgggaataatggttgttgtaattaaaattcccgtcaatgcctccggcgtttgcacctgatttgccacatatccaaactgatctagaaccaaacccggtacaacccctcccaaggccatgccgaatttaaagaaaaatccgataatagcgtatatgagaccgcccattcttttcccggtcttatactctccatattcaattgtttcaggaataagcgcccacatatatcccccggcagtgagacttcctgcagcagccagcaatcgaaaggaaagtatcaggaatacattacttgacggaacgaaaagtaaagctaagaggccgatcatattcagtaataatgcatagtttagtaatttcttcttccctaataattgatgaagctttggaataaacggtaaaatgaccaaagcaggcaaacttcccaacaaaccgtaccacttcactaaatccgctctttctaaattatacgttacgtaatagatgccaaccgaattactgattgaattcactccaaaaataataataaagaaaatacttaatacaactagaggccgattaacacgaaattgctcaaatatatccgaaaatttaattttttcttccgatttttgaagcgtgacacgctcttttgtgcttttaaaacaaaagattaaaaggcacccgcctataactcccataatacccatggttagctgccagccaagagattcgctgccggaattatcgcttaaataagcagccagtaagggaacaaaaaatgcaacgacaagtcctccaagattcgcaaataacatacggacagacgttatactaacaacttcttgattatttctggtcattgcagatgttaacgcgccatatggcacgtttatcatggtgtatgtaagcgataagccgacataggtgatataggcatatattaatttccccatatccgaaaaatccggggttgtaaaacagagtattgccaatatgacaaagggaaaagctccgaataaaagatacggtctgaagcggccaaacctgctatttgttctgtcaactattgttccaataaaaggatcagcgagagcgtcgatgattctaaccactaaaaacatcgtaccggctgttgctgccgataaaccaaaaacatctgtatagaagaacaaaagatacgtagacactgttgcataaattaaattacatgcaaaatctccagacgcatatccaactttttcaaccatgctgatcttctttacattttcactgagcatgatttctccccttttcgatcctttacataaggaacatgatgaaatggtataacatttctttaaaattatcggccagtgagcggcatataaaagcgctttcaaaaaaatgatagcggtttactttcacagagcattttcaacatccaaatggtgatcagatagcagtgaacaggataaaagcttggctttcgctttttatatacctccaattaaatcgagcctcttatccccctcccatttaagacctttacatgatggacaattaaagtggttttattagtttgttgatcgaacaaactaacttgatttcatattataaaatcttttctgctttttcaactcttttttcagagaatttaaaaccgaccaaaggacataccatgttgtaattgccgactgcttcgacagacgttaagtaaaccccctgtgtcacctgactgatttattaaatgataagcacttccatcatcttttgtttagaaaaacttattaagaaacatgcacttgaaaaaatgcgaatcatatataagtgatatcccgtttaattggttgaggaggatattatgaaacctatgctgccttttgaaaaatattttggggatttagaactgatttatgcattttatggagctatgcctaccggtgttactgtttcagaaactggtcgtattttcatttgttttccgaaatggggagacgatgttaaatttacggtggcggagataattggggataaattgcagccttatcctgatttacaaaccaatttggttaaccctgagaatatcaaaatgactttcatcagtgtccaaagtgtagttactgatggaagaggaacgctttgggtactagatacggcggcacccaatttttctgaaccaattaaaggcggggcaaaattagtcgctgttgatttaaaaaccaatacaatcagaagagtttatacctttacagaagatgttgtccttccaacaacttacctgaatgatgtccgatttgattttcgtgttggaactgcaggttatgcctatataacggattcttcttccaaaggaccaggagctattatcgtcgtggatttagaaaccggaaacgcatttagacggttaaatggagcaaatccaacttcaccggattcctattttataccgaaaatagaaggcaaaattttgatgaatcgtaacagggatggttcaacttccccatttaggctggcatccgacggtattgcgatttctcctgacggaaaggtattatttttttgtccactgaccagccgtcatctgttctcgatctcaacagaagccctgagagatagaaatataccggacatggatttactttatcatgtggcgtattggggagaaaaaggcgcgtctgatggaatgattacagatgcgaaaggagccatttatgccggagattatgagaacaatagtattcgaaagatgctgccgaatggcacaatggaaaccatcgcacatgatccgagaattttatggccggatactttttcgattggtccggatgaatacttatatgtcatcgtgaaccaattacatcggcaggctagatttcattatggaaaagacttacgacagaaaccttatagtttacttcgtatcaaaattgatgaatttcctgctcctgctttttgaaaataaaaatggccggttcaattttagaacataattagcttcatttagccttcatcctaaaccgaataaggggttacaataaatacgtgtcctcaattataacttcaattttttttggtcatattctggtcaaggaccaaaaatgttgttcttttaatcttatgaccaaaaccaaaaaatcccctggcaccaatagtgccaagggattgagagattaatactgagacatgtattgttcgcgctcccacggatgaacctgtgtgcggaacatatcccattcgatttcttttgcttcgatgaagtgttcgaacaggtgctcaccgagtgccgcaaccatgacttcgtttgatttgaattcgtcgagagcttccgccagcgtcgccggaagatctacgatgccgttttccatgcgctcttctttgctcatgacgtagatgttgcggtcaatcggagccggtgcttcaagtttgtttttgattccgtcaaggcctgctgcaagcaatacgcttaacgccaggtacgggtttgccgccgggtctacgctgcggacttcaacacgcgtgctgatgccgcgggaagccgggatacggatcagcgggcttctgttttgcgcgctccatgccacgtagcaaggtgcttcatagcccggaacaaggcgtttgtaagagttcactgtcgggtttgtgacagccgtaaagcttgtcgcgtgttttacgataccggcaatgaaatgttttgctgtttcactcagctgaagatcagcgtctttatcaaagaacgcgttaacgctatctttaaagagtgataggttgcagtgcataccggaaccgtttacgccgaacagcggttttggcatgaatgtcgcatgcagaccgtgtttgcgggcgatcgttttgacaaccagtttgaaagtttggatgtcgtcacaagaacggatggcaccagcatatttaaaatcgatttcgtgctgacccggagcaacttcatggtgagatgcttcgatttcaaagcccatttcttcaagctcaagcacgatatcgcggcggcagttttctcccaagtcagtcggagccaggtcgaagtatccgcctttatcgttcaattcaagcgtcggttcgcctttttcatctaatttaaacaggaagaattcaggctcaggtccaagattgaaatcgctgaaaccgagttctttcatttctttcagaatccgtttgaggttgttacgcgggtcaccttcgaacggcgtgccgtccggattgtaaatgtcacagatgaagcgtgctactttacctttttcagccgtccatgggaagattacaaatgtgttcagatcaggatataagtacatatcagactcttcgatacggacgaaaccttcgatggaagaaccgtcgaacatgcatttattatcaagtgctttttcaagctggctcacaggaatttccacgtttttaatcgttccgagaatgtctgtgaattgaaggcggatatactttacgttttcctcatttactaattttacgatgtcttctcttgtgtactttgccatttcgtaaaactcctcctctaaaaggtaaatgtatatagcaaaacagttgctaacggattaatgaaagaatcgggacatgtcaccttggcggaaagtatttccccgctggaaacggcctgcctgcatcagttcgtttttcagaagctttctgagttcgtcatcagacagattgtgcttcatcggtttggcggttttttcggatttttcttccggttcggcagatgccttatccagaatttgtttgatccccgccatattgacgccttgttcaatcagatttttgatttctaacagtttatctacatcatggaatgaaaataatcgtctatttccttcgcttctcgctggaaatatcaatccattttcctcataatatcgaatttgccgggcagaaagttctgttaactgcatgacaatcccaattggaaataaaggcattgagcggcgaatgttatcactcatctcaatttcctccttttcttatcttagtctcattataggtgatgttatattttgtgtcaacacaatgtaaggaatcttaacatcaaattctttgaaaattgcaaacggcctaaatcagctctttttccattaaagcatttacggcgctgcaaatcgcatttttcacgtgcgcgtaggttaatcctccttggacatacgcgacataaggcggtctgataggtccatctgctgataattcaatgcttgctccctgtacgaaagtgcccgctgccataatgacatcgtcttcatatcccggcatatagctcggataaggcgtcacatgcgcattaatcggtgaagcatattgtatcgcctggcaaaaagcgatcatcttatcagggtcctgaaactcaactgattgaatcagatccgttctcggcgcattccatgcagggtttgacgtaaagccgagcttttcaagaaaacgggcggtaaataccgctcccttcaagctttgcgccactacatgcggagcgagaaagaaaccttgatacatttcctgcagtgaataaagcgaagcgccggcttcacttccgattcccggggaggtcatccggtaagagcaggcctcaatccacttggctttccctacaagatagccgcccgttttagcaaggccgccgcccgggtttttgatcagggagccggccataagatccgctccgacgtggcagggttcccgctcttctgcaaattctccgtagcaattgtccacaaaaacaatgacatcttctttgatttcctttacgaaacgaatcatctctttaatttcatttattctgaaagacggacgattcgcatatccttttgaacgctggatgccgatcacttttgtattcggccggattgcagcccggaccgcttcaaagtccactctgccttctgatgttaaatcgactgcattgtatccgatttgaaattccttaagcgagcctgaatactccccgcctcttactccgacgatttcctcgagtgtatcgtaaggcttgcctgttatataaagcaattcgtccccgggtctcagcacaccgaagagcgcgattgaaatcgcatgcgttccggaaatgatttgcggccgcacgagtcccgcctctcctccgaacacatcagcatagatcttctccagtgtatctcgtccgatatcatcataaccgtatccggttgaaggcgtaaaatgcgtatcgcttactttatgttttctgtagctttgcaggactctccattcattccgttcactgatttcttctattcttttatgaacggcggagatttccgcttctgtttcttcggcggttttttgtaaaagagcgccatgggtcagtgtgtcaaacatgttgtgtataccttccttacatgaatttcttcagttctccgagtatgctttgttcttcctgtacataacctgagacttcgtagcgttcattttcttcattaaaataaaggctgtcgatcatggtctctgatttgatgcgtgacatcaatttgccttcggcggcaggcacatgaacttcatacggcgtcatcagctcccggcgcaaataagcttcgatttccgcttttagttttgcttcatccccggcgattctggcgctgatcatgatgtggccttctcccgctgtcgggatgaagtcaggaagtgtatcatcacgtttgttataagcggtcagcaccggaatatcatctgcctcaagctcttttaacagaccgaggacagtctgttcatgtccggcataatcttcattggatgaatcaatgacatgaatgatcaagtctgcttccttcacttcctcaagcgttgagcggaaagccgcaatcagcgtcgtcggcaggtcctgaatgaagccgaccgtatcagacaaaaggacgctgtagccgcttgggagcgccatctttctcgtcatcggatcaagtgttgcaaacagcagatcttcttcaaagctgtctgagcttgttaattgattgaaccatgttgattttccggcgttggtataaccgacgagtgcagcctgaagcacgccgttctttttacgtctctcccgataacggcttctgtggcggataaccgttgaaagctgcacgttaatttcgtgtatgcggtttctaatgtggcgccggtctgtttcaagctttgtctcaccaggccctctcgtcccgattccgccgccttgtcttgagagattgattccttgtccgcttagacggggcagcgcgtattgaagctgggccaattcgatctgaagctttccttctctcgtcttcgctctttttgcgaaaatatccaaaataagctgcgtgcggtcgatgatcttcgcttcaattgcagtggcgagtgatttaagctggctcggtgacagttcatcattaagaatgatcagatccgcttcaagctcttcacacagcgccttcagctcgtctactttccccttgcctatatatgtagcggcatccgctctgttccgtttttgcgtaatccgggtcagcaccgttccgtcagccgtttttgtcaatgaagcaagctcttccatggaatgttcaaagtgctcatctgtcatgtgcggaagctggcagccgaccaaaatgaccgtttctttttttccttcctgttcgttcaaatggatgttcctttctgtgtcgtattgggcagtagtactatcataccaaacccgcagggcgtataccacacatccggcgggttttaaagagagaaataaaaaagagacccctcaaaccggctgagaggtctattcgtaagctgccgcctcatcttttataagtaaatcctggctcttgatcgtcattaaatcgttttttaagtattggtctcccattaaaagtctcatggcctgagcgcggattgatttttcaatcacgtttctgacaaagcgcccgttgctgaatttaatggggcttgtcgtgcttttcactgtcattaagtaatcttttaacttccactcggcttcctggcttaattgatactcccgctctgctatcatgcgctttgcgatgtccatcagctgagtgacagagtaatccggaaaatcaatgctgatagggaaacgcgattgcaggccgggatttaatgacaggaaatgtgtcatttctctcgagtaccctgccaggatcagaataaattcatgctgtttgtcttccatatgcttgacaagcgtatcaatcgcctctttaccgaaatccttttctccgccccttgcaagtgagtatgcttcatcaatgaataaaatgcccccgagcgattttttaatcagatctctggttttttgcgccgtgtgtccgatgtattcaccgaccagatcggcacgttccgcttcgatcagatgtcctttggaaagcacgttcatttcgaagaaaagcttgccgatcagtctcgcaacggtggttttcccggtgccagggttccctttgaacatcatatgaagagcttgttttccgactttcagcccttgttcggcccgtttttggttgacgaatatccacgcgtaaatttctttaatgttgcgtttcatttcttccatacccactaatgtgttcatttctttttcaatttctttcagaatgctgtgtttggcttcatttttttgcagggcggcctgatattccgcctcagcttctgcatttgtcagcacttgcttttggccattaagaatgatgttaatttgtccgttatttttataggttacagcgcgctccaacatgctcacctctctgttctctctttatcttactcatgatgaagcggttccgtgacatccgcctatcatcatgagacccgttttcctctttatctgtcactttttccgttctcttcgggaatgatgttgaatcctgcgctttcccgagaaatatttttcatttcttattgtattcaacagaaacgggaggacaaaccatttatttttattttccgggaaatgttgggtatatttctcatttttttcatgaatgacagccgtacaagcaccttttgaatatcatcatatgctgtaatgaggtgatggagaatggttaaaatttttatagaccccggtcatggcggaactgattcaggtgcaaccggaaacggacttcaggaaaaagcggtcacgctggagatcgcgctggctttgcgcacgattctgacgaatgagtatgaaggagtttctgtcacgatgagcaggacaagcgataagacggtcagcctgacggaaagaacggatgccgccaacagctggggcgcagattattttttatccattcatattaactcaggaggcggaaccggattcgaaagctatatttaccccggtgtcggagcgccgacctcgacttaccaatcagccgtccacacgcaagtgattcaagcatcgggttttaatgaccgaggaaaaaaaacagccaacttccatgtgctgcgggagacaagtatgccggcgattttgacggagaatggttttgttgatacgtcagctgatgcaaacaaactgaaaacagccagttttattgaaagccttgcaagaggacatgccaagggcttggagcaagctttcggtctaaaaaaaaaggctgacttatataaagtgcaaatcggtgcattcaaagtgaaagcaaatgctgatgcgcttgccgccgatgcggagtctaaaggttttgacgcgattgtgcttccaaaaggcggcttatttaaagtgcagatcggcgcattctcttccagagattacgctgaagcgttggccgcgcgggccgaaaaagccggatttgatgccttcattatacaagactaaatgaaaaacccccgctctcccttttttgggacgaacgggggttttttgttattgaagtatatcggcgacaaactgagaccaagcttcaagacgctgatacacattttcctctttcagttcgctcagtttcatccagcggccggcgatttgatctttttctttcacttcgacttgtgccgcagacgctaactggagcgcagaaaggatgccgatatgcaccttccctacatcgttttcatcatcattgatcaggccgagtgtgacaatgttttgtttgtcctcctcgcgaatgtacagttcttccgccagctcccggtcggtattctgtttcagcacttccgaaaatgaagccgctccttccatagggttcatgtgtccgccgaagccgagagaaagcttattatggaggcgcgattcccctccgccggcgagccgttcatacacaaacacctcatcatcgcggcggatgacgacatacggaatcggctgtttaaatcgcgggtcctcttccgcgtcgcctcttctgatttcaaaaaaatgcgcctcaatttgagccataatgtttacgatacgttcatcctcgctgttgactccctgaaatgtcagcatttcgttttgaaagacgtcactccgcggtgcagccaagatgatttcatccattttattcatgcccgttcctcctgtcttacctctccattcaagccaaaagagcagatattatatctgctcttcatcttggccaaaataaaaatcttcgtccttaatcggttctaccgtcgcctttttgtagccgttccctttcatggagaagaaatcatgtgattttgttttggtgtttaatccgtttaatacgatcggattaatatcctcttcttcaaagtaaggatcgaaccctaagttcatcaaagctttattggcgttatagcggatgaatttctttacatcgtgtgagagtccgacttgatcgtacaagtcctctgtatattcaagctcattgtgataaagctcttctaaaagctcaaccgcaaattcgcgaagttccgcttttttcgcttctgtttgtttattgtatatttcttgggcaagcagtccgacatatacaccgtggatcgcttcatcacgaaggatcaggttgataatttcaccgctatgcatcagttttccttgtccgtagaaatataacggataatagaaaccgctgtagaataggaagctttctaaatacacagatgcaaccatggctttgaacagtgaaatctcgtcatcttttttaatcgctttgtagagtccgacgatgatttgcgcttttttctgcaaaaatttgttttgtttgacccattcgaatacttcattaattgtttcagtcggtgccagtgtcatgaaaatattagagtacgattttgcgtgaacggcgttctccatcatcgccataaaattcagcacggctttccgctggtggccgtctacgtgttcagccacgatcggcattcctgtattcccctgctctgtatcaagaagagtcaatccggccagtaccttcatatacgtgtcttgctcgtttttcccgaggtacttccatgtgaggatatcgccgtttaaagcaatctcttccggaagccagaactgtttcacattttggttatagaacatttgggtaaagtcgtcttcatgctttgaccagtttgctgcgtcataaattttcgtcactataaactctcctttaatcaaacaacacaagaaaggcagctatcttgcccggtatctttcgttcttgcatagtaaatggttttgatgcctctatggtgggcatacagatcaatacggttcagatcacgagttgtcatcgtatctttcaaaaacagggtaaagctgattccctgatcgatatgctgctggattgtcgcgatcatatccaccactttgaacatgtccatatcataagcttctttgtagaagaaccagttattagacgctaatcccggcatcgggtaatacgtttttgaatttccgtatgttctttcttcgatccgttccatgatcggcataacggacgccgtgctggattggacgtaggaaatggagcctgtcggcgcgatgcacagtctgtagctgtgatacataccgtgttcagcgacaaacgccttcagctctttccagtcttcgattgtcggaatgtgcatgccctcaaagagcgcagcgattttttcgtatgccggtgagaactctttttcgatgtatttattgaaatattctcccgttgcataagtggagccttcataatgctcaaacgtttcgcctttttctttcgcaagctcagctgaacgctggatggaataaaagttcaccatcataaagaacgtattcgcgaaatctcttgcttccgggctttcataagcgatgccgttttgggcaaggtagccgtggaggttcatggcgcctaaaccgatcgacttcatcgctttgttcgcgcgtctgactgccggcgcgttgcggatatccgtcgtctcagatacatgagtcagggaatccgtcgcgagtttcaccgtgcgctcaatcgatttatgtttcatgacattcaaaatatttaatgaaccaaggttgcaggaaatgtccaagccgatttcgtcttcttcatcataatctgtgtaagccgaaacttgtgacgcttgaagcacttcagagcaaaggttcgagaatttcacttttgatacgtggttattcgcgtgctctttgtttacgttgtcctggaacataatgtacggataacctgactcagaacggagaacggcaagcttttcaagcaatttgcgcgcattcactttttcttttttgacacgcgggttgtcgacaagctcctcatacatcgccgtcatgtccatttcgtccatatgctggccgtattctttataaatcgtatgcggatagaatacataagccgctttgtcctcacgtgcaagctcaacgaacttatccggaatgacgacaccgatagaaagcgtcttgacgcgcacatcttcatccgcagaaatctttttcgtatcaagaaaatcattgatatcgcggtggaaaatgtttaaatacgccgcgcccgagccttgtctctgtcccatttggtcagcgtaacggaacgcattatcaagaagcttcatgacgcctacaacgccttttgtggcgttttcaacatctttaatcgcttcgcctttcgcgcgaagcttggacaggttaagagaaaccccgccgcccaatttagacagctgcatggaaatatcgatcgcccgtgaaatatcgtttaaggaatcattgacttcgagcaagaagcagctcaccagttctccgcggcgttttctgccggcattcaaaaatgtcggtgtactcggctgatattcctggttgatcatcaggtttacatattcttttgctttctcagtatcgccgtttgcgaagaacagcgcgacgattgagattcggtcctcataacgctcgaggattcttttcttgtcattcgttttcaaagcatagtcattataaaatttaaacgcactcatgaaggaaggaaaacgaaacttctttgcgtaagctgtcttaaacacttctttaatgtcttcaaaagagtaaaggcttaagaattcctcttcgtagtattggttttcaatcaaataatccagcttctcttttaaatcgtgaaagtaaactgtgttttgattgatatagtcaacaaaatagctatgtacagcctctttatctttatcaaactggaattttccatcttgttggatcatgatttcgttatttaactggatccattttggcacttgattttgtgacaactctttctacctcctgagtaaacaattcaacgtctttagatgtgccgctgagttcaaatttgtgcaagatcggcacctgatattgtctcgaaatggtatcggcgctttttgcaaagttatcgccccatactttgttgccgctcgcagcgactcctaataagagatgggcgtatttttcgagaaatgattgtgttgatgccggtacctggccgaagtttgtcgtgtatgtgaccaaaacaaacggagtgtccacgtggtccgtttcgtccaccttgcggatcagctgaaagtctgttttattcacaaaacgctgaacattccctgtctttgaatcaaatatgatttgaaccatccttatcacgacctatcaaaaataatgaatctcttaacactatatatagtatactaacctctcagaaaaacacaacatattgagatcgatttataaaaaattcatatttttgaaagagcggactttggctctggcccgattaacgcccaaaaaagagagcagaacgagaatcatctctcatcctactcaaggtgtcatgtgtaagccgatgtctatcataacatgaaaaaaaactgcttagtagtctagacttttattcttattttttgtaagaatcacattttttttcgctttcaacggtttcttcaatctccacatcagcaccgatttctttcagtacggctttcagagcgcttgtgatggaagcctctctgatcagttctttgccgtcaacgatgatgctggttccatattcatagcaggaatcatcttcacaagtttcttcccaatggttgattatcaccttgtgtttcaatcgtctcaccctctgcatgatcaatgtcagtacttagtgtagcttgtgcggcccgctttgtaaattcgaacgcttgtgaaatttattcaagctcatccagcgccgtttcttttttcagttcgattttattcgttttttcatcatagcggtatatttttaagtaaccgtcctcgacgatgccgaaacgattatgttccagctgcaccatgccttctgtctgcggttcggcatccgatgagccgccgtcatcatccgtcaccaccgtctcatgattgctgcaagctccaaacagcaaaaaaacagcgatccaaacgagcgtaatcctgattcttctcagttcattttcactttcgaacacgattttccgaacccccttttatgtttccgatatacggcctgcaatatacagatgcgcatagaaaaagaccattgttcatggtctttttcaaaaagtctattcaagctcaagctggacgtttttttgcggggcgaacgtggagatggcatgtttataaataagctgctgcttcccctccgtttcgagcaaaacggtaaagttgtcaaagccttttacctggccgcgaagctggaagccgttgagtaaaaacaccgtgacgaacgtattgtcttttcggatttgattcaaaaactgatcttgaatattaatcggtttcatgtttcgtcctccttggttctcaatacaatactgtttcgattaaatttccagttttcctgctatgcactcgaaaatttccttttttttctgctcaatatcaacaggcggcgtcatatctgtccatgaaacgggcattttattgcgaaaccaggtcagctggcgtttcgcatatcgcctagaattttgttttaattgctccacagcctgagggagcggcacttttccatcaagatattcatacagctctttatagccgatcgcctgaatcgattggctgtcccggatattcatatcatacagccgctttacttcgtcaagaaggccggtttccagcatcaggtcaacgcgctcgttaatccggccgtacagcacttctctgtccattgtaagaccgataagaaccgcattgtaaagcagctcccgtttttgggttttaagatgctctgacattgtttttcccgatacatgcagaatttcgagcgcgcggatgactcttcgcgtgttgttttgatgaatggctgccgccgcttccgggtcggctgccgcaagcttggcatgaagcgcttccgccccttcttcagccgccagtttctccatgcgctcccggaatacagggtcgccggagttttccgtgaacgtatagtcatacagcacggactgaatgtacagacccgttcccccgacaatcatcggcagctttcctctatcggcaatctcggtgatttttccccttaccattttctgataatccgccgttgaaaaagtgtcggacggctccaaaatatcaatcaggtgatgcggcacgccttctgtctcttcttcggtgactttggccgttccgatgtccatccctttatatacctgcatggaatctccgctgatgatttccgcattcagcattttcgcgagtccgatgcttagttttgtttttccgactgccgtcggtccgacaagtatgacgacaggctgttttttatttttcaatatgtatcactctcttttataaatctccccctaattatagcattcatttcttcaggcacctatccattttgccctttttcctgagcgctaaacgtccgctaccacccgatcggctcgtttccgacaacctctctcgtttttcctttgagcgtatggcggtgcgttttccgtccttcctcccacggatcgtaaacgacaccgccgtgctggatctgaatcggctcattgtaggcggcaaaggtggtctctgaaagctcatggtaatgtgttccgtcaaccctcgggatggcagggccggaaatgccgtaatacctatgaaaatggccgttttcaaacgaggtgatgcccgtatagaaatgtgtatgctcatctgtattgctgccgttctccggttgcgaaaagccttcgatcacatggtaatgtccctgcactacatccgtaacagcccggtatgcgtgtgtgtgcggaggtttttttgaccaatctgactgatacaggcccacaaaagctcactcctttatttttttgataaacgcccaatcaaaaattggtgggctgaatactctgttatcatctcaaatttattcttggaggtacctaaattatgaatgaagaatacacatacgaagcagatagtgatatgagacagtttggacggcccggatttgggttcggacggccgggattcgggttcgggcgtcccggattcggattcggcttcggacggccgggttttggttttggccggccttggtttggccgcccttggtttggcgggttcggacggccgtttggtttttacggcggaccgtttgtcggagggcttgtcggggggcttgtcggaagcgctttgttcaatccgtatttgtacggaggttacggctacccttactatccgtattactactaagacaatcaaaaagggctcctttcaggggcctttttgtataggcctaatgtcttgacttggcgggcaaagttcggatattattttattttactgccttaaacaaaaggcataaggattatgatgagagggggatttgatatgattctgggttatatcttcctcacaattgctattttatcagagtcaatcggcgcggccatgctgaaggtctcccgcggatttacgcggtttttgccgagcgcgcttgtagtggcaggctattcattggccttttatatgctttcactgacactgaatctcattccgcttagcttatcctatgcaacatggagcggagccggaacggtgctcgcatccattatcggagcgaaatggtttcatgaaaaactggacaagcaggccgtcatcggactctttttcttattggccggtgtcattttgatgaattggtagaaaggagaggcatgctgatgaaaggattactttgcttggcattagccattgtatcagaagtgttcgggagcacgatgctgaagctgtcggacggttttacgcacctgtggcccgctctcggcgtcatcgccggaatcggagcctcttttatgtttttgagcttctctttgaaaagccttgatttatccgccgcatacgcgacatggtcaggtgtcggcaccgctttaacggcaattgtcggcttttttgtttttaaggaggccatgacagtcaaaatgatgatcgggcttgttttggtcatcacgggcgtcatcctgctgaaccgttccaagtctcaaaaagctaaaaaaaatcaaacggcccggagctgaccgtttgaactcgtcaagcgcgggcagcttttacttcaacctcaagctccatctccacgtttccttggaccgctcgtgaaatcatacatgaggactctgctttttgcgctaacttcctggcgagcataaagtccgtttcggctgcatccggctttaataatataaacgggcggtgaatgattttctggtacgtgaacacaccgtttgtgacgtctacaattccttcagattccatatgtagatcttctttatccaagccgcttctttccatcatcgccgcaagcgttataatataacaggtcgcggccgctccaagcagcatttcatcaggatttgtgccttctccgggtccgtccatttccttaggaatggacacagccgtttccagccggccgcttttaatatcgccgacgtcattgcgatttccgggccaatttgcttttaaataaaagtgatgttttgccaagggacaaacctcctttttttcagtttactcatctttcactcgtttgtctttttttaagcttacgaatactcttgattgatcactctttttatcgtacggacaaaccggtaaaattcctccgtttttgtgaattccctttcgcggtaatcaaaattatcaaaaaacgcttcccgctgttctctgctgatctcaagctgtatgctcagcccggtttgcgcctggttattgatattttcggtgtcaaccccggccagaccggtttttgaggttgccaattctgcagaaaatccgtttcgttcgagagctctcaccaattttttcgcccgcttccggtcgcttcctccgacaagagtatttttctcgtcgcctttataaccgtgaactgcgataacataatggtgctgcttaatgctttcgactgctgaaggctcatcgaacctggtgctcgtaatatgaagagtctggttatcatgcgtttttaatccctcaaacagataggttgaataatcatctctgaaagagcggacgatctcgctcaccccgccctcaattctccctccgtgcggcgacatgatcaatacggggctcccctttcgcttattgtacgatatatgataatcatcggggtcttcatgttcagccaaatctttaaaatctgtgtatgtatcagaagaattcgagggatcagggtctgacgcataatgagcacatcttattagtaagaccattgctacgataatgatgacattaagtaaaattcttttcatcagctctccttctttgctcctttctgaaaaatgacatgttcattatatggatttttgtcaataggtcttatcttaacattctattaacattatcatcagtgaaaaacttcccggtttcgaaaaatcaatggattgtcacggttcaagcgctcaaatgccgggcatcagtgaaaaaaggttgagagagggcaaaaaaaaagggaggaacgcccgaattttcaggggcgggagattcacggccggaaacggacggcatcaggaatacgcttttaaaaatgaatatccgcctcccgaagcaaatgcacaggacagaatggagcccgtcaaaaaagttctcatctgcctttttgtacagcaaaatgccgttacagcccgctcatcccctttttttatcataatggtccgttttgaaatggagccgtcttttttcatatatataatatcaatcggaagctgtttttccaaggaatgtctcaatattatgttcatatatatacctccttccgccggcttcactataaacgaacaaacgttccgtttcaactcgatttcttctcctgaaaaagccgcaagtaaccagcgctcctgaaggacaaacaaactgaccgaacatacggcctgttcatatggtatagagagaatcgccagaatgggaggaaaagtatatatgtttggttactcaatggtacaaatggtgcggtcaaatgctcataagctggactggccgctcagagaaaacgtattacagttatataaacctttcaaatggacaccttgctttttgcacaagtttttcgaaaaaaaggtgaaaaacagaaagaaaatgtcagtcatcattgaatttgaagagggctgccatgaatccggttttcacagcacaggacaggtcttatcaaaagaaaaacgctgcaccataaaaaagcagtttcaaacaatcaattgctgcagcgccgaagtcactccgtccgcccttcacatgcttctttcgcaatgccgggatatccgtaaaatctatttaaaccgtgaagtaaaagcgctccttgatacggcagctgaatcgtctcatgcaaaagaagtgacccgtaacggcaccgtattaacaggaaaaggcgtaaccgtcgccgttattgataccggaatctatcagcatcccgatttagaaggcagagttatcggatttgcggactttgtcaaccaaaagacagaaccgtatgatgacaacggacacggcacccattgcgccggtgatatcgcaagcagcggcgcttcatcttccggtaaatatcaggggccggcgccggaagccgatctgatcggagtcaaggtattaaacaaatcaggatcaggaaccttggctgatatcattgaaggtgtggaatggtgcatacaatataataaagaacacacaaagaatccgatcagaatcatcagcatgtcactgggcggagatgcgctcagatatgataaagaaacggacgacccgctcgtcaaggccgttgaagaggcatggaatgaaggaatcgtcgtctgcgtcgccgcgggcaactccggtccggaagctcaaacgatttcaagccccggtgtcagcgagaaggtcatcacagtaggcgcctatgatgacaatgatacggccggcaatgaggacgatacggtcgcttctttctcaagccgcggcccgacggtgtacggaaaagagaagcctgacattcttgcgcccggggtcgatatcgtatctctccgttctccgcgttcataccttgacaaattacagaaatcaaaccgtgtaggctccttgtatttcagtctgtcgggcacgtccatggccactccgatctgtgcgggcattgccgccttaatccttcagcagaacccgcagctttcgcctgacgaagtgaaaacactgatcaaacaaagtccggataagtggacaaatgaagatccgaacatttacggagcgggcgcagtaaacgctgaaaacgccgtgccgaaagagtaacctttttatcatgagaacggggtcgtctaaacctgcagatgaccccgttttttaggtgaacagatgaaacatttataatgaaggaactcggaatgctccagaaccggctgtcagaaaaaaagatcaatgcaaggcagtgtatttctaaaaaaatagggaataagtatggtgtagataaaaggaggaatcacaatggcacttacaaacaccgaattgtctgaatggctgcaaaaacagatcggacaaacgcttgatatcaggaaaggagagctgacagacagccgaaacgagatttctgatatggatcagatcatgcttcaccttgatgatgttctcgtccgccggacaaaccatcccgatgactatgtagcggacgaagaactcgtcttaaaagggcacggcacaacctatacggaggaaggaaatgtcccgcttccccaagatgcgtatgaaatccctctgctcggcgacatcaccatccaaaaggagcaagacggattaaaggtacatacagatcgggccgtttatacaatcgggacccggaaagagcaataaaaagaaaaaacgccctgaatcagcggcgtttttttattggtttttttcttctgaatatccgtggaacatcgtgaatgcgcaaagcataatgcctaaaataatgataatcggaagccagatcacggcaaacttataatccggttcggcaaaagcgccgatgaccgctccaaagcaatacagcaccaaggcaagcgcgcgcaatacagcatctctcgtaaactgcttccgcttgtccgctttgtaaaaccttgcggtgagatcttcaaaaaaattagcgagcgttcccgttaatacggtcgtggaaatccccgctacaccaagttttctcgcggctgtcgtctgcattcccattgcgaagctgagcagcataatcagcacataaacagaaatggcatctgcaaaaaagcaggagaacaaagcaaacagcagcaaaacagctccttcaatagctaaagcggcagttaccgcagggggccagaatgatttctttttattgcccacaagcagggccgcggcaataacgccggcaataaatccgattaacgaggttaacgatttgagtacggcaaggtgccacgagttgccgatcgccaggccgaacagaacgatgttccccgtcatattggcggtaaagatatgtcccaggcttaaataaccgatcacatccacaattcccgctgttaaacaaagaagtaaaagtgcaatatttcggtatgtagtcactgtcaatgtgatccaatcctttctcatgctgattccaacatataagtttactctttgccatttcatatgtccagccggcgtgccgctttttcagagcataaaaaaactccggcgaaccggagaagctactgaacgataaataatactctcgtgccgtcggaatatccgctcatttgatttccaacccatgaaccggctccgcggttatccgacggggttacatatctgatatcagcccccgccccgccttctgtgcagactgccatgggccattcatcacggtcaaacccgggctttgtcggaattcctttcaatgattctttccttctattctccgctccgccccgatcaattgtacaaatctcagaatgacctgccgaaatggcgtcttttatatgatttcccgtctccggatattttgacagcgggaaatacagcacctgatcgtatcgggatgcggcacgagcagcactgtccgaatggatgccggcgcccgtaaggccgaactgaagagagatcaccaaaagcagacttgccgcccatttcataaacgcattcattcacatcctccttaagaagttgatatgaagcgtaaatatgtatattagccggatttaacacacatgatgaaatggcaaaaaaagtttgctgttttgttgataatcaacgaaaatggcggctttacgatttgtctattgaaccggcttctgtttccttatatattttagacatacttatgagccgttgtgatcagtgtcttcggcagataaaaggaggaatgccgtccggtcggcaggcaccggctgtttgttatgtcttttcaaaaacatgaaggcggggaaatccagatggaaaaaacaatgtttcacccacactcacccgagtttcacgaaaacccttttgcggttttaagcagattcagagagcaggaccccatacataaattcgaactgcagcgtttcggaggcacctttccggcttggctcatcacgcgttatgatgattgtatggcgtttttgaaagacggcagaattacgagagatgtaaaacgagtcatgccgaaggagctgatcgcgaagctgaatgtcagtgaagatatcgattttgtctcagagcatatgctggcaaaagaccctccggatcattcacgacttcgatctttggtgcatcaggggttcactccccggatgattgagcagcttcgcaccgggatagagcagatcacagaagagctgctggatgaaatggaaacaaaagcagaccctgatatcatgagagatttcgccgcaccgcttccgtttatcgtcatttccgaactgctcgggattccgaaagaggaccgcgccaaatttcaagtgtggacaaacgcaatggtcgacacgtcagaaagcggacaagatgcgaccaaccaggctctcaaagaatttaaacaatatatgaaaacactgatcgaagaaaaaagaaaacatccgggtgaagacctgacaagcaagcttatttacgctgaagaggacggccaaaagctgagtgaatcagagctgtattccatgctgtttttgttagtcgttgccgggcttgaaacaacggttaaccttctcggctccggcaccctggcgcttcttctgcacaaagaccagatggagaagataaagcggcagccggaaaatatccagacggcggtcgaagagcttttgcgttatacctctcccgtcatcatgatggcaaatcgatgggcgattgaagatttcacctataaagatgtttccattaaaaaaggcgatatgatatttatcggcatcggttcagccaatcgggacccggaatatttcgatgatcctgatacattaaatatagcgagaacaccgaaccgtcatatctcttttggattcggcattcatttttgtctcggggctccgctcgcccggatggaagcatccattgcctttactgcgcttttaaaacggtttccgaatatagagctgaaaggcgcgcccgaggatgtaacatggagaaaaaatgtgtttttgagagggcttgaaacatttcctgtcagattttaacatctccccccctgtttatcgggggtttttttaatgtcttataaacagaaatcaatacgacaatgaaaatttagtacatagtaaatttagttctatatggataaaaaaagcggccggattgctccggccgttctctattaccgttttaccaactcatttgtttcgtccagcttttttctgaaagatttaaggaaatttgcgcttatcgttcctttgtttgcgtacagtttttcgcagaatgctttaatggcgttttgcggctttggttccgacagcattgtgacatgattggaagagtgaacgtccaacaggtgaaactgtttcatctggcgttcccattctttccaatacgcatcatggtctaacggaatttgttcttcctctgctgtcagataacgttcaagatgtccgaggaacaaaccgcttttattacggaagtagtagcattgcagcgcttccggatgaggcagcggcttcatgtcatactcttccattccgtaagcgagctgcgtcttcatcatttgctccagctgcatccggatcgcttcttcggattttggcagaccgcgctttttggcaaggccgatcaattctttcaatacttcttcttcctcagcctggacggtaatgtcttctctgctgattaatgcctcttcaaggttttcaggcttaagatatgctgtaagcatcgtattgatcgtttgcagcatgactgacttaacagatggttttctttctttccatttttcactgtacggggtgtcgatcatgacggcgctttttaccgtatgaccttcctcctgcaagaggcgcgcggtttcatatgcaagcatgccgcccaaggaatatccgccgaggtcataagggcctttcggctgtaccgcttggatgattctcatataagaagcggccgtctcttcgattccttgcagcggctctttccctgtcaaacctcttgcctggatgccgtaaaaaggtcgctgactctttttggcgaatggctggtatgcttccacgcctcccgttccgccgtgaaaccaaaaaacaggacggcctttttctctttcattcagcttgacgagttcgggaaaattccggcccgtctcctgcggttggttcgtttttaacagcatgcagatctcctgaagagtgctgcatttctgaagagcctccagactgatgcggctgtctccgtcctcaagtttcttcaacagctgaatagaggagattgaatcgaagccgtattcagtcagcggcttattttgatcaatttccgctgccttcatccccaaaatgtctgccacaatgtcagccgcgctctcgcagcggatctgaggattctgtgaaaccggtgcaaggctgatgtcttctggctgaccgccgttccaatacttatggttttcaaaaggatatgtcggaagcggcactctttgaacagatttgccttggtggagtctgtcccacggtatatccgcacctttcacccagcaaaatgcaagtttttcgagattgttttcagccaacagcgtctccgtgacgactgtaccgagagtcccttccagtaaaacgccgatatctcctgatccagtctgctgactgcctgtaaagaagcttttcattccattgctttcttcggaaaatgctctgtactctttcagtttttccagcaattcatcttgattgcgggcaacgagtgccaggcggcagttcatcgcctcacggccggtctgaagcgtataagcaatatcccgcaatgacagagtatctccagtttgcacaaaatcagccagctgacttgcgaccgccttaagacgcccttcgctcttagcagaaagcacgataagctgcggttcatgcacagattctttgtctttatggctcgggctgtactgttccaagacgacatgcgcattcatgccgccgaagccatagctgttaattgcggcccggcgcgggatcggtctgcccgtatggtcggtgagctgtgtccattcctgattgtcttcggtgaaacggaagcggcttttctgaatggccatttgctcatttgcagctgtaaatccgggaatacccgggatggtatgatgcttcatggccatcgccacttttataagggcggccagtccggaagcgagttcgccgtgcccgatgcaaggtttcacggtgctgatataacaaggcgcgctttcctcttgatttgcagactcgccgtaacccgctttgattgcattaaactccagcgcatctgccatttcggaggcaatgccgtgcgcttcaatataagtgacagtttgcggatcaacatcggtgtcttcgtacgcttttttcatcgcggccttcattcccgccggattcggtgcgtgaagcgacatgcctttaccgccgtgagacactcctgttcctttaatgaccatgtgaatatgatcgccgtcttcaattgccgcctcaagcggtttgatgatgataacgcccgccccttcgcttctgacaaagccatcggcatctttttggaacgatttcgcccggccgtttttgcttaaatatcccattgagtcaaaaccgataaagcccttcggcgactgcagaatattggcggcgcccacgacagcctgctcacattcgttatgacggattgattgaaccgccctgtgcaatgccaccagggttgacgtgcaggcagcctcgtaatattcactcggtccttgtaaattcaaggcatatgatattctgttcggaatgatggacgggatggctgttccattgttcggatcgctgttgcccgcggcaacgaaaacgcctgtcggtctgcttgataacgccttatttgtcaggcccgcatcctccattgctttccatgtatgcatcaaaagcagaaactgctccggccccatttgtgatgcctctttaggggaaattccgaaaaagagcgggtcaaattcgccgacaccgtcaataaaaccgccccatctgagactcgtgtcattctcatcaccggcgtaacggcgccagtcccagcggtccgccggaatttcggtaatacagtgatccccgtttacgatgtgctcccaaaaagactggatatccggggattgcggaaactgagctgacataccgataatcgcgattccttgcttgacatcggcgttatcacaaggcgtatgctgtttcctcggtaaagtgcgctcttctgtttccgtggccctggcctcttctgaatgcttatgatcggcaagcaattgagaaaacttgctctcatatgctgacgcgaagtggcgggtcagctcctccgcggtcggatactcgaaaaacaatgttggattcacatcgatgtccgcctcttggccgatctcttttgtcagcccgatcaggcttgctgaatcaagtcccaattccatgatattcgcgtcagaacgaagagatggcccgggttcatccatcatcttggcgagcttgccaaggacgtagctgcggatatcatctgtcagactgccggcagaaatcggtgctcccgcattcttaacagccgttcgggccggctgattcatctgttcggttttcggacggaaccgtttcagggcatagccttcaaaacgcatcaccacttccgatcggctgctgatgacatctgcgttaatcagaatcatttcccccgtttgtttggtcagcttgatgtgcagccagcaatcgataagatcttcagggctgctgaaggtgacggaattaatgccgaacggcagatagctttccgcctccgtttgatccaataaagaaagtgaggccaagtaagcactgttggcgatgaacggatttacggcataatgatgcgcttgttgtgagtcgctattgttcaggttcactttcgctaaaacggcatcagagcctttgtacaggcgggtaatcgttttaaattcttctccccacacgacgggtcccgttccgtctccgtataactcatctatccggcccacttcccggtaagagcgctgaatggccgccagatccgcgtgctgcttttgaaacggataggggctgcactcggcatacgccgctatgctccaatcaggagacgtgcggctgcggtgcattatgctcagttcaaatccatccccgttttgtttcgattctgttttcagctcgatgcgatcgcctttttttacggtaatggggctgacgtaattcagttttttaatttgtcctccttccgcttcaggaaaaagatcacaaaaatgatcgactgccagactgttatatgtagcgccgacgagtaccggttctccgctgaattgatgccctttcacgtatggatcgtcatcactgtataccgcctgaacgccggcagcgttttctgattcactgaattgaaaagaagtcccgtggtcaaaagcgtaggccggcagatgaacggcgtgctcttgctgcaactgatcaaacgcgatattctctcctttttcccattgccgcgcacgccggccaatatcagattcagagaaattgagattccgctgatccatgcggtaagcggccagcttttccagcagttcctgaacggaagcagccgtaaatgccgcccgatactccgaatgatgcgttcttttttgcagcgcggatgcgatggcggccggatgaagagatggcgtcttttctaaaaaggccgccagtctgtcaagataggcttcaaaactccattttgttttcgctgacacagggaaaatatattcctcatcgccgtgacgggcctgatcggaattcgggctgatatattcttctacgatgagatttgcatatgccccgcctgccccgaaggaattaatcatgcttctccgcgggatgatgtcccccgtttcggcatccctcatacgctcccaatactcggttttttcctgcaggtgaaaagccgtttgttcaaggttgatattcggattttgcggttttgcgttaatcgtcgggactaatgtttcccgctccatttgcagcagcactttcgcgagctgggacatgccggaagccgcctctaaatgaccgagatttgacttgacggatccaagcgcgcaaaaacgttttttatcagtatattgcgcgaacgcatttgtcagggcaatgacctcaatcggatctcccaatacagagccgtttgccgctgattcaacataactgattgtttccggattgattccggccttgtcgatggaagccgccatgagcttcgcctgctgtttcggatccggagccgtgtacatctgccttccgccgctatggcacaacgcgctgcttttaatgaccccgtaaatatggtctttgtcggcaagcgctttggagagcggcttcaagagcaccgccccgactccttctcccggcatcaggcccgtgccggttccgaagcttttgctttcacttccctgttcaagcaaattcgcccgttcgagcgcatcatatttagacggttcaagcgtgagattgacccctccggcaatcgccatggaacagctgttaagcttcaggctttcacaggcgagatgaatggcgctcagtgagctggagcatgcggtcgtaacgcccatgctcgggcccgttaaattgaaaaagtgggaaatgcggttggcgatatgccaatcccctccgttagagctgagcgcagctttttccaatgacgggatattccagaaatattgattgtacatactgcccataaatacaccgatgccgctgtctgattcctgccattcgtttactctttctaacgagtagcctccgttttcaaatgtttcccatacggtttctaagcttagacggagctcaggcgtcatctccatcacatggtcttcccggatgtcaaacaagtgatggtcaaaagcgtcaatatgctgcagaaatccgccgtaccgtgttttgtgttcttcttttcgtgtttcttttgccatcgttttcagaagaccggacttccatctgttttccggagctttcgtaatacagctgtctccggcttttaaatgctcccacagctcatcgagggtttcagactcgggatagcggccgctgatgccaataatggcaatgtcgtcacgatcagaacgattaacggtgacggtttctgtttccggctttggcgcttttggctctttttgttcagtgataaaccgccgcgtttccgtgacaagcggcaccggttcattcattgcaggttccggatgctttgtttcaggaggcgcttgttcggctccgaatgcctgttgcagcttatccgggtaagtttccagcaaatactcggcaagttctttcgtattcgtgtgttcaaataagaccgttttcggcagctcgcccgtcaatgtttccagttcacggataaaattcacctgcaaaatggagtcgatgccgtatttttcaaagctggtttccggctgaatgcgctcgggagcaagctttatggacttggctaacgtttcttttatgaattgcacagtccggtctgtgactgagaaagacggttctgtgaaatcagcctgctctttggaagccgcagtttcttcaaccgcctgcgcgtccggctgcttttgcctgatgacgccgtcgctttctgccgccacgatctgctggccgaggtgatgtgacgattccgccataaatgtaacgtaccgatatccctcgctttccagcgcagactgccacgcttcaggatacagccccgggcatccgggaatgcgcagtttggcgtcttcatacagccaccagccttccaaaagaccgaatgtcagatgagaataaaccgaatggctgctaatctcatttaataacaaaatcccattctttttaagcaccactttggcattgcgaagtgtccgccgaatattttttgtcgcgtgaagcacatttgccgcaattaccgcgtcatatgcgcccgcctctataccctgcaaagccgggggctcttccacattaaaccgcttataagtcaaatacggattgtcgggaccgtattctttttcagcatgcatgaaaaaggcctttgacagatcggtgtagcaatattctttcacatgatgtttgtactcttttaatcttttgaaaacggccgcgctcgtcccgcccgtccccgctccgatctctaatatccggatttccgcgttcgggtcttctttcaggcgttcttcaatgaaagccgtcaatgtgtcagcgagcacctcattaaagtagtctgccgtttcattgtttttatagattccttccaccaattccattgaggaatcaggaaacagaacatcagtggcagaaactctgccggataaaatatccggcaaagctctgagagcggtctccactaaggtgatcatcgcctgtttgctgctgtccttgagtaaaggagctttcttttcatcccattcttgccacagaacgtccgcacgctctatcggacctgttaacacatacgtactgcctgactgtttcaaaaagcctttttgcaccaagatggagatgctttcttccagccacctgccgtaaaacccctgcatgacaggctgcgtttcgttttccgtgaaaaatccgacagatttcagctggcctgccaatagtttgtaaagaagatcttcagtgttttgcaaagccgtcccctccttaactcaattgttgtacatgtcttgttactttaggctgatagcttcgcagtttttgcatcgccgagccgtgatgttcagggtatacttctatcatttcttccggtttttcctccggctcttccgcctgtttcatcatgacgaactgattcaacgggccgccgagcaatcgttcaagcgccgccattgcttccggcgcttcaattgatccgactcccgcctgtttcatccgttcttgatagtcggcagatgatacgattccgacactgccccagtagctccaattcatcactgccgccgaatacggccgaacttgagccaaatgagcggcaaaggcatctttgaaactgcatccggcagcataattgctttgtccggccgctcgtgcaaatgattgaacagatgagaagaacaaagcaaagtccagcggctcattttggaacacgcgggccatattcacgctgacattgactttcgcagcgagcacgcttttcaaacggctttccggcatatttgccaggctctgatcctctaaaacaattgcggaatggataattccgttaatttgcgggtgcgtgcgtttgatcgtttcatacgcccgtgtgagctcattcggatttgccgcgtcagcttcaatataaatcggcgccgggccgaattggctgagtctgtcgattttttcctggatggcgctgttatgttttcgtctgccgatccaaacgactcgcgcctgatacgttttcacggcatattcgctccatgcctcgccgatgccccccgcaccgccgatgacgacataaacgccgcctttttggtaggcgggccggcttgacaccggctgctgtacaggaatgaggcgctgtttgtaccagtgattgttccggtacgcccatgtattgccttgctcatcaaacggcgctgagaacagctccgcctttgaaacgtcttccggacagccggcatcaatcagccttgtttgccagttcggatattcttttgcgagcgagccgaccaaaccgtgaatgcctgcatgagccggatcaataatgtccgccggctgtacggactgtgtttttattgtgactgcagtcaagctgattcgcttgcctccatattctaaagcaagcatggccttaatcactctgtacatctggatgacgcccgcatcctgagcttttaccatgtcatcagcgctgtgaaaaggagcgatccatacgatatgcccgaaagaccctgttgctttcagttcagccgcaacagcctctatttcatcctccggggtgatatgaagccgtttcgcagaaggatgatgcaattgaaaagccgcgctttcctcatcccccgcgataaagacaacctcttccgtcttatatgccgggctttgatcacggaattccgcgagatcccacaccggagccagaaggtttgctccatttaatgatgtttccggcgcggggccttccatcattctggaagaaatccctttaattctgacacagacccggcctgtctcatcgcataagtcaatgtccatacgctgtattttttcatccgttccccgggagctgacatacgcccacatgcttgtcgtgcacgggctgaaaatgtccagttcttcaagggcgaacggcagtgacagctggttatcatctgcgtgcagcttcagaccgattgtcgcttgtaaagctgaatcaagcatacacgggtgaagaacgtattgatctgccgtttcttcgaggaaggaaggcagccggagctcagccaatgcttgattgcttccgatatgaatctgctgaattccttgttgtccgggaccgtagtcaatgccgattttgctgaataagccgtaacactgttcagaagtcagtatactgaggccgcattgagctttcagtgcgcctatatcacggtgcggagcctccccggcgctgagaatgccggcagccccctgacagtgtatctgcctgccgcttgcttctgtttgtgaatccgtgtaaacgtcatacacgatttcaccgttttccctcgggttcaggctgatttgcgcttcaatcgggcggtttcccgcttcgatcggccgaacccaaacgatgtttttcaggcgggtgacagatggacgttccttttgccctttgactgcctgagcaaccgccgccctagccatttccaagtaggcaacgcccggcataaccggcttgcccttaataagatgatcggtgaaaatcgtctcttgtcccgtaaattcggatcggtaccgctgctctgttaaatctgatacattttcgtgaagcagcgggtgcagcacccgcgacgtcggcacagcttgcggtttctctgctttcggccgattgtccgtgatccagtaccgctctttcgcaaacgggtaagcaggaagactcatccgttgaggcttgatatcagaatataggccgtcccatttgatatccgcgccctgcacccataattccgcaagcttgtcattctctcggcggcttatcagctcttcgatatccgcctcgccgtttgcacctgccagaatggatttcagggaggttttacccgcttttcctttataaatgcccgctatatcataacgtcctttcgcacagctctttagcttgtcccgcagttcttcggccgaggaagcgataatggccgctctttcttccatggcatcacgcccctgctgaagcgtgtaagcaacatcggcaagatccgcatccgtaaaagaagcttgcgccagctgctgcgcctgttcctgcagacgttcttcttctttggccgacagcacaaagatttgagggtgtgtgaaaacagctgtttttctttcttccttcgggatatattcttcaatgacgacatgggcgtttacgccgccgatgccgaaagaactgattcccgcacggcgcggcagatgattgccgttttcgtctttcaatgccgtccattctcttttttcctgtacgatgtaaaacggactgtctttcagcttgatatacgggttgatgacctcgctgtggaggctttttgcaagtgttttatgcttcatctgcatcagcactttgatcacacccgcgacaccggctgccagtgacaggtggccgatattggttttggccgaacccagaccgcagtgactcgcgtaaacggcggaatcgcctgttttttcgtacagcttttgaaaggcggatttcaggccgttgatttcgaccggatcgccaagctccgttccggttccgtgcgcttctatataagtgacggttctcggatcaatgccggctttgtcataagccgttctgacgacttccgcctgggctttcgggttcggtgtcgtcaaggagttcgcgcgtccgccgtggttgaccgcgctgcctttaatgacgccgtaaatatgatcgcccgctttttccgcttctgacagctttttcaaaaacagaattccggcaccttcactgacggcaaatccgtccgccctgtcggagaatgttttacatttcccttctttgctcagcgcccccgctttgtcataagcgatgtggccttgcggagtgacgacggtattcacgccgccggcgatcgccatatcgcagttcccgttttcaatggcgcatacggcgtgatgaatcgcgaccagcgagctggaacaagccgtgtcgatcggttcactcggcccgtgcagattaagcatatagctgacgcggttcggtcccgctgacggactcatatttgcggctgacgcaccgccgatatccaggtcggaaaacagtgagccgtatccggtattccccgtgccgatatacaggcctgttttcgtgccggaaaggcttttagcggaatatcccgcatcttctatcgccttccacgcatacatcattaacaagcgctgctggggatccatctgttcggcttccagcggtgaaattccgaagaacagcggatcaaaatccgcaactccgtcaataaatccgccccactttacatttgttttattggcttcattaagcgggtcaccgtaatactcacgccagtcccagcgatccgccggcacctctgttatacagtcttttccctcttctaagttgcgccaatactcatcaatatttgcggccttcggaaacactccgctcatgccgacaatggcgatcggttccggtttatgttcagccgccgtctgaacaggctgtacggcagtttttgcaaatcgtttgttccctgccagtctgataccgccatcatcagttacgctgctttgtttttcttctttcggctgtgtgctgccggcaaattgtgtttgatagtcttctgctaaatgatgcgccaaggcttgaatcgtcgcatattcaaaaaatacggtcggtgtcagatcaagctggtaagtgtcattcagcttgttggcgaattccgtcagcgtaatggaatcaaatccgtattgattgaactccaattcgatatcgatttcttcaatgtttattttcagaagcccggaaacctcttttgccagcaattcctgaagttttgccgtcaggtctttcggcgcaggcgtttcatccgttttcttaaccggtgcaaaagcggccgcaggagtcttttgaagcagcttttcccgcattacggcgcggtttccttccatgacgagcacgcttgttttccccgtgctccatgctttgtaaagagcttctattccggtctcagtgcgcatcggcgttacgccggttcttttttcggtgagcttcgccatttcttcattgacttgcattccgccgtttttccaaagcggccaattgaccgacaatgtgtgaccgtggcggtacattgcggtaaccagcgcgttgcggtatgccgcatagctgtccataaatgcgtttgccgccgcataatccgcctgtcccgcattcccggtgacgccggaaatggatgagaaaacgatgaaaaagtccagcgctaaatgctcggttgcttcatcaaggttgacaaatccgtccgttttaggagccaatacactgtaaaactcttcggttgttttctttgcgatatactgatctttcatcacacccgcgctatgaatgatgccgtgaaggccgccatattccgtctcaattgttttgaccaggtctgccgcagtttgagcgtttgttacgtcagcctgcttgtattccgcttttgctccgagtgattcaagcgattgcagctgcatccgctgattctcgcttaatgcggaacggcctgtcaaaaccagtgtcggctctttgactttgcgggcgatttctttcgcgaaaataaagcctaagcccccggctcctccggtaatgagatatatgcctccgtcgttccacggaatgcgtattttgccgccggacacggccgtttctttgacatctgcgctgtatcggatgccgttttcatatttgatatggctgtcatcagcccgtgttttattttctctgatgatgtctgtgattctgccgttttccgccggttctatttcaatcagctgggttttcagttttttatgttccaggccggctgtttttaacaaagctgaaatgcctgagagcagctgatgcttatctgttttagagagaaccgtctggatgaggacgtctccatccgtctcttccttcagcagtttttgcagcgtctccaatatccgtcctgtataatcacggaagcgcgccgccgctttcccgtgctgggaggtcatttcaatacatgcagctcccgcggcttcaacggcttgtttcaatccggcctctgtgtcacaaagcaacacgatatgccgggcaaaaaccggttccgtttgaacggcggtttcatcacttcgggtccataccggctcaagcatgagcgtttccggagctttttcttttttctcaggttctttttcagccgttctgaatgacaaacctttcagccttacgcaaaccttgccgttttcatcacaaatatcaagatcgcgtttttcaatctggccggctttgtggtcttcagaaagtctggcgtaaacccacatctcggcagcgcatgcgctgaatacttcaagctcctgaaccgcaaacggaagcatcagtttttcatcatttgttccggttaatatgcttgatgcctgcaatgcagagtccattaagcccggatgcatgacatactcctgtaccgtgtccgcacaagccgcatcaagtgacagtctgcccaatacgaaatcatcacctgtataaatcgctttgacaccccggaaagccgggccgtaatcaaaaccgattttgcggtacatatcgtacacttcatctgcagaaaacggtgtctcggcggattgtgatctcagcttttggagatcaatgaccggagcctcggcgtcagggcggactgatactgccccttggctgtaaacggacggctgatctgtttcccggccgctgtaaatgtcgaattgaacgtcatttgccgtttcaggaatgagacggatgttgacatgaaccggctcgtcttcaatggtgatcggccgcacccaaaccgtattcttaagcttgacgcttccttgtccggccggaacttcagatgcctgttccattgctgcgcgcgccatttcaagatgtgccactcccggtaaaatcggtacgccttttacaacatggtccgcaaggtaaaattcttttcctgtatagattgaactgaaccgctgttctgcaaggtttgaagtatttctgtgcagaagcggatgaagcgcgtcttgttttccggcagatacagtgcttgttttttcgtgttttccggtgctttttgccgcccaatagcggtcttttgcaaaaggatacgatggcaggctcatgcgtttaggccgacggtctccatacagcttcgcccaatcgacgttcagccctttgacccataattcaagcagcttcgcgtatttgccgcgtgccatccatttttcaacggcttcttgaatttcttcatcttccgtcagcatttgcagcgtgcctttgtctattcttcctctgtacaagtccgcgtgcttatctccagtgataaactgtgacagtttttcctgcagttcttctgcagatccggcaataaccgccaggcgttcttccatggcgtcccttccgatttggagggtatatgccatagaaacgagggaggattgatcgtaccgtttttcagtaagcgcacgtttcagctgttttgcctgctctttcaggcgtttttcatttttggcggacagaacgaaaagacatgggtcgatatgagaatcatctgcttcctctctgtcttctggaatgtattcttcgatgacgacgtgggcatttacgcctccgatgccgaatgagctgatgcccgcgcggcgaggctgttcgtttccgcgttcgtccgtctgcgtcttccattccattgtctcccgcaccagataaaacgggctgtcttcaagctgaatgtacggatttaccgtctcacagtggagactttttactagtgtccgatgcttcatctgcagcaaaattttaataatgcccgctgctcccgcggcaagggataaatggccgatattcgttttgaccgaccctaagccgcaatagccggccgctttctcttttccgtctgcaaacgagctgaacgcttgtttcagtccgttaacttcaacgggatctcccagttctgttccggtgccgtgcgcttcgatataagagactgttttcggatcaatgcccgcttttttgtatgcggctttaatgacttccgcctgttgtttcgggttaggcgttgttaaagatgccgcgcggccgccgtgattcaccgcgcttcctttaatgacgccgtaaatatggtccccatccgcctcagcggctttcagctttttgaggaaaaagagaccggctccttcaccatgggcaaaaccgtcagcctgatcagagaacgttttgcatcttccttctttactcagcgcgcccgctttgtcaaaactgatatacacgtccggaagcacaatcgtattgattcctcccgccaaagccatctcgcacgtcccttcttcaattgaagaaacggcatggtgtatggcaacgagcgagcttgagcaggcggtatcaatcggttcgctcggcccgtgcagattgagcgtatagctgacacggttcggtccgacagacggacttgtattcgctgcggatgacccttcaatctccgcatcggcattggctaaaagagaaccgtagccggtatttccggtcccgataaacacacctgtctttgtgcctgagagactctttgacgcatatccggcatcttcgatcgctttccacgcgtacgtcagcaagagacgctgctgagggtccatttgctccgcttcccggggtgaaatcccgaaaaataatggatcaaattcagcaattccgtcaataaacccgccttggttgacgtttgttttattggcttcttttgcgggatccccgtaatagtcccgccagtcccagcggtctttcggaatctcggtcatgcagtctttgccttctttcaggttctgccagaaagcttcaatgtcttctgccatcgggaaaatcccgctgatgcctacgattgcgatcggttccggcccttggccccgctgcactgtctgcggaagtgtctcaggcagagtgcggcgtcgcttaacggcagggcgcgtgatttgagtctcttttaccggtcttgccgattgaaccgtttttgtatttaccgcaaaccgtccggcaaattcctcttcgtattcactgattaaatgaacggcaaattcatggattgtcggatgatcaaagaaaatcgtcggcgttaacgtaagccggtacgttttgtttaactggttcgtaaactcagtcatcgagatagaatccagcccgtattttgtcatttcttcatgaggatcaattttgtcaatgtttacttttaacagtgaggccgtctgctgttttaacagatgcttcactttttcaagcaggctgtcagcatcaatgtcatgacgtacgccggtctctgcttccggatgatcattctctttgcggaacagttttgctttcatgtgtttcacatctccttcaacaaccgtcatccgggctgtcccgctcatcaagccttgatataaagccttgatgccggcatctgtgccgagcggtgcgattcccgcctcctgcatcagcatatcttccgtctgctttcctgcctgcattccgccttctttccataacggccagctgacagaaagcgtctttccgtatctttgtcctgcggcttgtaaagaacggcggtactcggcatacatctccataaagacatttgcagacgcataatcagcctggccgacgcttccaagcacacctgataaggatgaaaagacaataaagacatctaatttctcatgttgtgacgcttcatcaagatacacaaggcccttcactttcggagcgagaacgtgttggtattcctctgccgtcttcttcaccatgtagttgtcttttataatgccggcactgtgaacaatcccgtccagcttgccatgccgtttgcggatattgcggatcaatcggtatacttctgcttcgtccgtgacatcggtctgctcatagaaaacagaagcgccggcagcacgtactgtttccagcatgtctttctgcttttctctgagaacggatcggccggttagtatgatgacggcgtcttttgtacggtttgcgatctcttttgcaaagatcagacctaaacctccggcacctcctgtaatgagataaacaccttcgtctttccacggaatgtccggctccgcttgagaaatatccatctctccccaatcagcggcaaagcgcttgccgttttcatatttcacatggacgctttcggcatgcatacggttttcggacactttttccgctatgccttcagcactttctttctcttcggcttcgatcatttgacagatcagcttggaatgttcaaggcatgcggtttttaagaggccggtaatgcctgagaacacctgctgtaagcctgctgaccgcgtaacagcctgaaaaagaacgctgcccttcggcttgcttttcattatggttttgatatggtcaaacagctggcccgcataagaatgataccgctctgcaatggatgcgggacgatcgtccaagataatgacgcttgcatgttcaagctttgcttcgacagcttgttttacggcttcatcgtactcacaaaggaaaataatatgctcttcatacgaagggtcgtgatcggccggttccggctgctctttccagaccggttcagcgagcaatgtgtccgtacggctgaccgaaacgccggcacccgcgttttcttccatgatccgtgttgagaaacctctcatccgcacacaaagcccgccgttattgtcatataaatcaatatcggctttttggatagaatcgccggctttattgttcgcactgaatgtgacgtgcacccacatatcatcagcgcacggattcagaacgtccagctcttctaaagcaaacggcaatgcggctttgaatggttccccgctttctgcaagcagcgctctcgtcacgttttgcaaatattcggcggcctgaagcgcaccgtccatcatactcggatgaaggatataatcagcttttgtatgagagacggattcaggaagcttcaatttagcaagcagccggtcttcgcctttgtatacaagctgcacccctttgtaacccggcccgtaatcagcaccgatcattcctttgtaaaacgcttgagattcgattgttccctgtgtgcaccggcgcttcagctgctcaatatccgccgcttcctccggttccttccggatgatttcagcgatgccctgattataaagaggagcttcttcaccgatagaatcgttatccccgtacattctgtattgaatctgtccgtcctcttcttcataaagtccgatatggacacggacagcctcctgatcggctatcaccggacggacccatacaatattctttaagcgcaggcccagagattcctctgttgccccgccgatgcttttctccgccgcggcccgtgccatctcaagggtaacggcagccggcacgatcgccattcctttaatgatatgctcagcaataaaatactcttttcccgtgaattccgaactgaaccgctgctcctgcaagacggatgtattctgatgtaccagcggatgcaaaagtttggtatccgtttgcttcaccgtttcctccggccagaagcgctcctctgcgaacgggtaggtcggcgcactgattctttgcggcgcggaatccggatacaataagccccaatcgacacgcgctccttcaacccagagcgccgcgagtgctttcagcttttcatcccgtgtctgacatgccgcaagctcttccatctcctgagctgacacttctctgcttctcactttttcgccccgtaagatgttttggtcattgccgttgatgaaatcctgcagctgacgattcaaatcgtgacgatcatgactgataaaaacggctctctcttccatcgcttcacgtccggtctgatacgtaaatgccagatcatgcaaggaaacatcgttttcggcttcatccagaaagccggataaacaagatgcataggcagtaagacgctgcttatttctcgctgacagcggaacgatataaggcggctgtccgtcatttgatccgctgatcgttttgttttcatactgttcaaaaatggcgtgtgcgtttgttcctccgagtccgaatgagcttaacgctgcgcggtgcggcgtctctctctccggcagcggttttctcttatccgccacataaaacggcgaaccgctgaatttgatattcggattcggtgacgtgtaattaatggtaggcgccagctcccgatgatataaactcatggcgactttgacgcacccggccagacctgctgctgtatccaaatgtccgatattcgtttttacggagccgatcccgcaatactgctcccggtccgtgtaacgtttatacacttgctgcagcgcggacatttcaatcggatcacccaatgtcgttcctgtgccgtgcgcttcgatataggaaatcgtctccgggtgaatattcgtgctgtctaaaacatgctggatgacgtcagtctgaccttttacactcggtgcgtaaaaaccgactttatccgctccgtcattgttcagaccgatgcctctgagcatggcgtatatgtgatctccgtcctgaacggcttgtgacgcctttttcagcagaatgacggccgctccttctccgcccgccataccgtcggctgaagcgtcaaatgctttgacatgcccgtcgcttgaaaaattcaatccgttttggtgcacatagccgatgctggtcgctgcatgcagagttgctccgccgacgagcgcgtattccgattctccgctcgttatgcttttgtaggctgaataaagaccgactaatgatgatgagcaattggaatgaacgaaatagcttggcccttttaatccgagcttatgggaaaccatcgtcggaattgtaccgctctgcgctaacacccatgacacatagccgtcgggagattcatggccttctgtcgttttttccggcaaaagcgaccgatacgaattattgcttgccgacatatatacgcttgtcttcggaatctctttcgatacatatcccgcgtcctcgacggctttccaagaatgaagcagcagaagccgaagctgaggatccataaattctgcgtctttcggagaaatgtgaaagaactcagggtcaaagagatcttttccttctatcgtcgataatgccggcacatagtcgggattttcgatcaaatcttcaggcacgccggcttcccgaagttcttcttccgagtagaaccggacgctttcctttccttctcttaactgcttccaaaactcatgatgatttttcgcgccggggaactggcaggagatccccactatcgccacactgtcatcaaagtaagacggcaccccgttttgcggtgtttgttctctttctctctcatcttggcaggacgcctctgattcagccgcctgttttgtttcaacaataaatcggctgatcgcctgaatggtagagtgttcgaataaatccgtgacggtaaaatcgcattcaagctcctgtttaatgcgttctgccgccgcaacagccagaagcgagtcgcctcccacatcgaaaaagccgtcttcgattttgatgcccgccgtattcagcaggtcttcccatattgcggtcactttcgcttccgcttctgataacggcagtctgcccgtcttttcagaccggtgaacgattaccttgcgctgttttaggtctttgcggttcacttttccgctcggtgttaacggcagcgcatccagacggataaaatgggcaggcgccatataatccggcagactcgataaaagatggttgcggagcgctttttcgtctgccgtatgaccggagcgggccgtataataagcaatcagctttttatgtccgttcttttcctgaaccacaaccgcctgatcaagaatgtccggatgttcgctcaatttcgtttcaatcgctcccaattcgatgcggaagccgcgaattttcacctgactgtcaatccggccggcatattctatatttccgtcaggcagccatctggccaaatcacctgtcttgtaaagtttttctccttcactaaacggattatcaataaatgatgccgccgtcagctcaggctgattgtaatagcctctggccagaccggcgccggccacgcaaagctccccggccacaccgtcagggacggggctgagcttttcatcgacgatataaagccgcgtattgtgaatcggtttcccgatcggcgtattcctgcttgtgatttccttttggccgcagctgtagtaagcggcataaatggatgtttccgtcgggccgtatatattttcaattctggcatgtttgaagatggaaactgactttttaactaaatctttcggaaacgcctcaccggccaccatcacatatttcacagggccgtcttctgtaaatgccgtatgccgctttaccgtttccagaaatacattaaacacggcgggcgcaaaattcagatgcgtgacctggtgggtttggatatattccatgcaaagctgcggatttttttctgcaccaggcggcaaaatgacaagccgtccgtttccgataaaccagccgaataattcagaaatcgaaacgtcaaatacgtaattcgtttttaacaaataggcatcctcttgtgcgaccggatactcagcttccaaaaactgcagcgtattcataatggctctgtgctcaaccatgacgcctttcggttttcccgtgcttccggacgtatatagaatataagcgagatgatgcggttttgaacgcggcgtcagttttgccccgctgacagaacgtccgctgttttcaatttccaccgtgctcacaccgccgatggccaactgttcaatcatgccgcgcgtcttttcctgtgttaatacgattgacacgccgctgtcagtcaacacgtgggccatccgttcgtttggaaaagccgggtccagcggtacatacgcgcctcccgcttttaaaatggcgaggatgccgatgaccatctcaaaagaacgcttcgtacaaatgccgaccgggcattccggtgtgacgcccttttcttgcaggtacacagcgagcgccgtgcttcgttcatctaattcgcgatatgtaagactgttttcaccgaatgtgacggcttctctgtcagggtggcgtccggctttttccgcaaacacttcatgaatgcagcgctcattcggctgatgggatgaacggctttcatcccgtttttgattgagcaggccggaacaggcttcaaaagcgatctccggatcagaaagcaccttttctgccagtttcatataatgctccgccattcgttcgatgaaagaagggctgtagacatccgggttgtacagaaattgcaggacggttcccgtttcttttttatagacttcaagcgcaagctcaaattcgccttcctgatgaatgtcttctatcatttcaatgccgagtgattgatatagttccgccagcttttccgctccttctgtccggaagaagttttgatagaaaaacgcggtttgaaaaacaggcgaaaccgcaggcgagcgttccgtcttcaattctttgacaagtgcgggaaacggatacgcggcatggtccagcccttctgccagtgtcagctgcagctccttcaaaaacgccgtaaaagatttggcgcccgtctccctgctcctgaccgcgatcatattaataaagtatccgatgacagactcaaattgagcctcagaacgccccatcgtcggcatgccgacgatgacatcttcctgattcgtatattgataaagcagtcctttgaaaatagcgagatacacaacggattcattgacattatgtttttgggcgcaaactttaatctgccggttcagttcatcaggaagcaagcgctgatacgcctgccctttgcacgtttgaaccgatgatctcggataatccgacggaagctcaagcaccggcagcggtccttccagctgctttttccaataagagagatgcgcttttcccgcttcgctttccagcagctctttttcccatttcacaaagtcatgataatctgcggcctgctgaagcatgacaggttctttgccttcgcttgcttttacataagcgtccagcagcgccgacataaacgtcataagagagacgccgtcaaaaatgatatggtgaatggtgattaacacaatcggctcccgcttcgcccgccggaatacttgaacacgcaggagcggcccggtttcaagcgagaacggttcttttgctttttctttaataaacgtaagcgcatcacgcccgcttaattcagaaagatccatttcttcaatcggaaaatgccgatccgtatcttctatctgatacggaaggccgttttcctcttttatcacactggtcaaaatagggtgctggcgctgcacggacaaaagggcgtttttgaatgtctcgatatccagcttttgaaaacgaaagcataacggaatgttatatgcgctcatctccggaaacattttctgaagcatccacaaacctttctggccttcagaaagcggacgttttgcagttgtccgcttgaaagcctgaagcttttgttctacttcagcgatggtgagcgttcctgatctgtaggcatcgagaagttctttatgattcataggtcttactcccttctatgatgtcttgcactcttttaaaatctaatgtcccctcagagacctgtttcatcatggcgatgatctcctgatccgtatactccttgttatccggagcggcggcttctgtttcggtttcttccgttctgtaaaacgtttcgatcgtttctttgtgttctgtcaagtaatagctgatgacgtctccgagcgtggcatagctgtaaaataacgccggagtgacttcaatgccgtaatgactcgtcaaaagagcggcaaatttggctaaatagatggaatcaaatccgaattccgcccagtttttatgcaggacgagtttatctttcgatattttcagcagactgtgtatcagctctttcaaatccgcttcgagccgtttttctgcgctttcttccgggatgcggcggctcacggtttccaaaagcgcatccggttttgatgaatcgtcccgccgtatgcctaaaaatcgttcggcacggcttctttcgccggcaatgacaaggcactgggtgttgtcttgagaaatgacgcgctcaaatagctcaatgccttcatctgtttctaacaggcgctggccgcttgatttcaggtacatgcccgtcgtctcttcaccgccgacggccattccgccgtttttccagaccggccagttgatgacaaaagcgtttccgctttctgattgttcgtttttatagttggcatacgccatttggaacctgttcgcgaccgcataatcacagcagccgaaatctcctaaaacagccgatgtggatgaaaagtagcagatgaaatcaggcgtttcgtttttcagccactcgtcaagaagcaggcttccgtttattttcggttcaagcgtactgcggaaattcccgatttcattttcaaagacggatgttctgctttcgatgccggccgcatgaatgacgccgtgaatggctccgaatcgttctttcgcgcgcttgatgcagtcgcccattccgatcggatcacaaacatcggcttcggcgtaaagaacacctgcgccgagattttccaggtctttcattttttctttcttttcttcattgatcggcgaccgccccgtgagaatgacatttgcctggtagttccgggcgagatggcgggcaaataagtagccgagccctcctaatccgcctgtaatgagatatgttccgccggttctgatcctgccgttttctttcgttagtccggttggttcggtgtgatagacatatcgttttccctcttccaagaaaacggtatggtctgtttcagctttcagctcgtcccaaatggttctcatccagtccgttatggccgctccggcttttctgaagtggccggtaacacttgttttcgggagaacaatgccgagcgaacgctcaaagccgatccatgattccaagtagcacctttccagaccggatgcatattcccccgccaataacagcctttccggctgcagaccggtctcagccattgctttgagaatatggacgatacatgaataatcttcgatgcagcttttatcttcaagcgcccataaatacaaaatggcagaagcttcaccgtactctttttgaatatccgcaaaagcgttcacatatgattgcggatcttcccgcaccacttggcagcggccggcggacagagcctcataccggtctccctgagcgataaaaataacgtcaatgccactgtcatacgatttgatcacagagacggcttcctgctgcttcttctgatcagataagaaagaaatcaccgttttgacttgcttttctccggcagccggcagagcctgttctttaagaacttctctaaaagccatcacttcaaactgttccgccggatcactttcatcagccggcgccttaacgggcgcagccttgctttgtacaggctgctgatgccagaagcgttctttcgcaaacggataagcaggcaggctgatgcgggccggaggacggtctccgtataatttcgcccaatcgatgtccaatccttttacccaaagctcaagcagcttagaatatttccgtttgctgatccaagcgtctatgattgtttccagatcatcatccgccgaaaatacggcaagcatccgtttgttttcttccgtgccgtcacggtgcagtccggcgctgttttgtccggcgataaatccattcagtttttcctcaagttcatgaagtgaatggacgataaaaccgagacgctcttccatcggcacccggcccgtctgaagagtaaaggctatgctcataaggtcgctgccgctgtatcttttttcacggatggcgtctctgagctgttttgctttttcagtgagccgttcgctgtttttcgcggacaggacgatgatggcgggctgatctgccggcgtctcatcaggttctttgtctgccgtatattcttctatgacgaggtgggcgtttgctcctcccgcgccgaagctgcttaaccccgcccttctcggaagctctttgccgccgatgacgggacgtttccactcaccgagctcctgctgaacggcaaacggcgtatacgcgaaatcaatattcggattcagctgttccgcgtgcagggacggcgcaatttggcggtctttgagctggaatagtatttttgtcagacccgcaatgcccgcggcgctttcacaatgaccgatatttgattttgcggagccgatggcgcaaaactgtttatctgttgtatcctcttcaaatgctttcgttaatccggcgatttcaatcggatctcctaatgcggtccccgtaccgtgggcttcaatataactgacggtgcgcgccgggacgtttgccctttcgaaagcttcttttattaaggcggcctgcgcattcggattcggaacggtgtatccgttcgttttgcctccgctgttaatggtgcttcctttaatcacaccgtaaatgtgatcgttatcggcaatcgcccggtccaacggctttaatacgaccgctcctaccccttctccgtcgacaaaaccatccgcgcggtctccgaacgatttgcacgtgtcgcctgcggaaagcatgttcatgactgacagattcatataatggatcgggtcggtcactatgtttacgcccccggcaatcgcacattcgcttgaaccgctgtatatgctctcaagcgccagatgaatggccgtcaaagaagaggagcaggctgtatcaacggcaatgctcggcccttggaaatcaaaaaggtaagataccctgttggcaatggaccaatagccgtagcctgtcgggtagtttttgttcatcgcgccggcaaaaacaccgatttttctgctttggcacaggttgtcaggcgtatagccggcatcctcgatactcgcatacgccgtttctaaaaataatcgctcctgcgggtccattcgctccgcttccaaaggagaaatctgaaagaacagcggatcaaacttgtccatatcctcaatgaagccgccccatttcgtataaatagagccttctttacctttctcttcatcgtagtaatcctgccagttccagcgttcccgcgggatttcttctatgcagttttttccttttttaatattagcccaaagctcagccgctgtttttgcctgcgggtagcgtcctgaaacaccgatgatggccacgtcgcgaaccgaactttgccggacggtctctttggctgcccgtttttccctccgccgccagtcagtgcgaagcggcttagcaggctgtacagcctgcggttctggtgatgccttccgttcttcctgaacaggcgtttgtcccgtcagtttgatcatcgcgtcttttttcgttttgattaagtgagcgacgagcgcctcaatcgtctgatattcaaaaaataaagtgctgctgacttggtccaatacatttcgtaacgcgtttgtcagctgtacgacgacgatagaatcaattccgtatttttcaagcggcgctttcggatcaatttgagccggcggaatttttaatgtttctccgattaacgttttcaagtactcggtgcttttttctgttaaagacgtgtcgcctttttgcaccgttgtttgcgcctgaagttccggcgcatgtactgcttttggcggagaggtccgttttccggcccctgatttaagcgttttttggcgaacaatgccgttgctttttgccgctataatctgatggcttaattcatgtgccgcttctgccgggaagaagacagaatgccagccttcactttctaacacgcgcttccagctttccggatacaagcccgggcaccccggaatacgaagggcagaatcttcatgcagccaccagccttcaagtagtccgaaagtaatatgcgggaacaggctgtttcccgccatttcatttaagagcagcaaaccgttgtcttttaaaacggctttggcgtttctcagcgtctggcggatgtctttcgtcgcgtggagcacattggccgcaacgacgatgtcgtatgcgcccggctctatgtcctggccggcaagcggcgcttctgcgttaaaaagcttatacgtcagataaggattccgtttgccgtattccgtctccgcatgcacgagaaaagctttcgatacatcggtgtaacagtattcttttatatggttttgatacggcctaagcttttcaaatatgcctgcgcttgtgccgcctgtgcccgctccgatttccagtatgcggatctcggcttttgaatgtttgctgatgttttctttcacataagccgttaatgtatctgacagggcgctgttaaagtaatccgcgacttgattgtgcttataaattccttcaacaagttccattgaagagtgcgggaacatgatatctgtcgccggcacgtcttcgcgcagaatgtccggcagtgctttaagcatcgtctcggctaaaacagtcatcgcttttgtatcggcgttattgagccattcctctttttcccgctcccatttttgccatagcgcggcggttgtgttttcggctcgcgccgacagtttatatgaatccgcattcccttccagatagccatgttccagaaggaaagcgatcgtttgattgagccattttttaaagtattcatgttcgggctcatacgctttaaggctttgcggcgtcagcaagtctgcttctttaagctgggcgatcaacagctgatacagaaaatcatcaagctcctgatgttcagcctctctaacaagacgtgcgccgggcggagcgaccttcggctgttgtgaaaagacaagcggctgaggcggataaacggaaatcttttctctttcattcatcccttcgactgcgaccggttttgtcgtatgaatgaaagccgcctgatcaaccggcagcgtcataagggtttcaagcgcctccattgcagcgtccggttcgattaatcccaatccgatctgatccatcagctgaataaaatccccgtcttcagccgcttcgctattgccccaatagccccaattcatcactttgaccggacaattccatgtctgatcaagttctttcgcaaatgcgtcactgaaagcgcatcccgcggcataatggctttgtttcacgttatgaataaatgccacaagcgaggagaagaagagcgcaaagtcaagcggctcccgtccaaatacctccgccatggacacacttacatcggcttttgcccgcagcaccgatttgaactcttctgtcttcatattatttaagctttgctcagacagatccattgccgagtggatgattccgtttatttttgtgtggtgctcttttatgaactgataagccctctctaaggaagcactgtcggcggcatcggcggaaacatattcaggcgccgggccgaatgcgctgagccggtcgagtttcgcctgtatggaatcattcagtgtgcttcttccgatccaaatgatgcgtgctttgtagcggcggatcatgtattcactccatgcctcgccaagataccccgcgcctccgatcacggcataaaccccgcctgtttggtacagcgtgccgtttttcggcatattgtcaagcggtatcagttgccgctcaaacagttgctgattgcggtacgcccaaatttgaccgtttttcccggcagaaagactgagcgcctcttcgatcggccagctgccgtccgtttctgtgtcaatcatgcggatatgccagtgcggatattctttcgccattgttccggcaagtccgctgactgcggcttgtgacgggtcggcgctgtcttgatccgaaaacggctgggcatttgctgtgacgatgcaccagtccaaacgtttttctccgtaccctaaggcaagtaatgctttcatcagcttgaacacatgaagaacgtttctttcctgttctttgaggctgtccgcactctcagcctgcggagcaagccaaatgatttgctccagttctttttgtccttcaagcatgtgcgtaagagatgtgatatcatccgtacctctgatcggataataggaagcgttcggcaggtgttcttttatgcgcgtatgtctcgaatccgttccgccgaatactgccgtctgcttatccaccgctgcttccccggctttttcaagcgcaacaggctcccaagccggaatcagcattgtatggccgacaggcgcctccgaggtttctccgcccgctgtttggcctgtgtcaagcgcccggacggacgcgcctttcatccggacataaactgtaccggcatcatcgcacatatcaatgtcaaattttcttacgttgtcatctgctttgctgccttctgtgtaccggatatatgaccagatatgttcaggacacggcccgaacacttccacttcctgcatcgcaaacggcaaagaaagctcgtggctgtctgcatcgtcatgtatcgatcggacaagcagaccgacggatgcgtgaaaagcggcgtccatcatactcgggtgaagcgtatactgttcttttttgtcatgtacagctgctgggagtgaaatacgggccaataatcggtcttctccgatcagcaattgctgtacgcccctgtatgcctctccgtaatccagaccgatcttctcaaaagcaccgtaacattcttccgcagtcacaattcctaaattgcaggaagttttgacagactcgatatcaatctgggcgcttcccggttcggtaatgaccgcttcaccctggctgtgaataaccggatcttcgccgttttctgcctcactgtatatttcataggtaatctcaccattatcttctgggtaaagggcaatatgtatttccttcggtttgtcttcaatcatgaccggccggacccaaacaacctgcctgagtgtgacgctatggtctttttccgtcacggcagcagcctttttgaccgcctctgcggccatttccaaataggcgacgcccggcagtattttttgtccgttgacgacatggtcagataggaaaaattcatctcccgtaaaaagagacgtgaagcgctgctgcgaaaaatctgacgtattttcttgtaaaagcggatgcagcactgtgcctgacgggcttttctcctgttttttctgcttcggaatccaatagcgttcttttgcaaacggataagtcggaacgcttgttttacgcggtttatccgaaccgtacagcttattccaatctactgttttcccttctgcccatacctcggcaagccgtatcggatcatccgtctcaggagcggcttcgctcatctccggcagctcagcttgtccgcgccataaaccggggatgttttcgtttccttttacgaaatcattcagcttttgcttcaagtcgcggatgtcatttacaaggaagacagctctctcctccattgcttgacgtcctgtctgaattgtataagccagttcagacagcaccgtcttttctgaaagcgatcgggctagtttttccgcataggccagaagcctgtctttatttcttgctgacagcgggatgagttttgctgcatcgttctcaggtgcaggcgctttttgttcaggctgaatgtattcttctaaaatgatatgggcattcgaacctgatgcaccgaaggaactgagcccggccctgcgcggataatgtgtgactttaccgttttcttcagctgacggttgcttccacggagcagtctgctgctgtacgtaaaaaggagattcctcaaatttcaggtaaggatttaattccgcagaatgcagtgatttgacaagcgttttgtgatgaagctgcaacgccgcttttgttaacccgctgatccccgccgctgattctgcgtgaccgatatttgatttgaccgaaccgatggaacaaaattgctgatcctgcgtcccttggctgaacgcttttgacagaccttcaatttcaatcgggtctcctaacgaagtacctgtgccatgggcttccacataactgacggtccgcgggctgatacctgcttttttcagacaggccttaatgacttctgcctgtgcagcaggattcgggacggtaattccgcttactttcccgacgtggttaacggcgcttcctttaatgaccgcgtaaatgcggtcgccgtcttgttcggctttttccagcggcttcagcaataccgcaccgactccttctccggaaacgtagccgtccccgccctcgccgaatgtacggcagcggccgtcacttgagtgcatgcccacgcttccgtagctgagatatttcgccgggtgcagtgacaagttcacccctcccgcaagcgcggcctcacattcgccgcggcggatgctctcaatggccagatggacggcggtcaatgatgaggaacaaacggtatccaccgcgatgctcggcccgtggaagtcacaataataggacactctgttggcgatctgcgcataattcagtgaaaccggaaacggatcagtctcagataattgttctgcgccgattaaggaataatctttatgcatcacccctgcaaatacgccgatcggatgctgtttctcccctttatttcccagcgtttcaggcgtataccccgcatcttcaatcgtttcccagcatgtttctaaaaacaggcgctcctgcgggtccatcgtttccgcctcacgcggtgagattctgaaaaactgcggatcgaagcagtcggcatcttcaatgaaaccgccccattttgatactgtttttcctgacggggacgttacgtttttatatgttttccaatcccatcgggacttcggaacttcagtgatgcaatccgtgcctgccttcaggttttcccaaaactccgccacacttttcgctttcggatagcggccggccattccgataatcgcgatgtctccggtgtttttatgatgttctggcgcgtccggcgcttcagcttcagaccgtgatggttcggctgcacgttccgcacattcaaatgaaacggtctttttcagataggctgcgagttcttttatatttgtatattcaaagagaagagtgggcgcgaggtccgcacccgtctttttattgatatcctgtacaatctcaagcaaagaagatgaatccagcccaagctcatagtagcctgcaagaacgtccagcgtctcccaaggctgcccaagcttatcagccaaaagcttctttaaaaacagaatgatgtctttttcatctgcgctttccggctcagttgcagcctgttgattctgttcggctgtattctcgtcttcttcgaaccgaaccgcttttcccgtaatgtttttaagctccgccaccttttgtccggatcggctgaagtactcgatcgtcatcgttgtgagttctttttcctgacggacgccggaagcggcgatacgcgccgtgcactcagattgcagcctgtcggcggccgtgaacgattcataatataaaggcagatgaagccggtttgtttcagaaagcaaaccgctcgccccgattccgctcgcatccaaaagtgccggatggaataaaaagaaatcttttccttcttcgcaagaaagctcagccagcattccgccttctgtttcgtacaatcgtccgttcgatttcatcatgccggaatgaaccaagtcatgatccaggcatcggttatacatgtcatcaagattcagagatctgcctgactgcttcacatcgccgaaatcaatggtttcgtcaaatgtcacagcgtctcttttcaccatttcagctgtcgcatattgtatattgtctgacagctcgtcaccttgctgtttctgccctgaaagggagatgagccactttccatctccgctatcagaacattgaatggtcagaatgattgcagccgtttcactgacggttaaaggctgataaatcgtaacgtgcttcaattcgagctcattgtatacataaccgtgttcctgaaaaacctgataaatcaaatcgatataagcaagaccgggcaataccgcttcaccaaagaccttatggcccttcatgatgggatgatccagtgagatattgattttttccgatatcattccttcccactcctctctcatttaaatgctttccaaaacatttttttcgcaggaagctcttgtttctccgccggtgcgtcaggctcttttaccagagccttacgtcttaatgacggtaccggcagcggctttcttttcattcgggtgtctttttcttcccaagcttccagaatgacgtgggcgttcgttccgccgtcggcaaagcagttgatggctgctgacggtctggctgcatcccattcgccggctgttttatgaaaatgaaaatctgtctttgttatatcaaaatgcggcatcggttcatctcctgagagaaacggaaccgtttgtttatgcttcagcattaatacgactttaatgaagcttgcgatgccttctgcgcaaagcggatgcccgatgttcggcttaattgacccgatgccgagcggaacatgctggccagagcggtatacggattgaatcgccttcagctcaagcaaatcagttacagcggaacccgatccgtttgcttcgatataactgatgtcttccggctttttgccgcttttgaaaagcgcgctttgcatgacatctttttgcgcctgcatattaggagctgacgggcctgccgttctgccgtcattgttcatggcggcggccttaatgaccgcgtgtatcgtgtcgccgtctttttgcgcctggcttactgtttttaacagcaccatgccgacgccttcaccgaggacaactccgcctgaacgcttgtcaaatacgtgaaatgccggcttttcgtttaacagcccgcgctcttggaacatccggtgcgccgcatccgtgttcagcaggctgacaccgccaactaccgccgctttgatatcgccgcttctcagtgcctgaacggccatgttcattcctgtcaaagccgatgaacaagccgtatcaagcacgatgctcggcccgcgcagatcaaaaaattgcgaaacgtttgccgctaaataattctgcccgcccgcaacgatcgggttgcgggtattcgcaagaatttcaggatcaggctgatgctggcttcggcctccgatatacacaccggcctctatacccttgatttcttcacgggaatagccggcatggcaccaaagtttcaagctctcttccaacaccgccaatgcctgagggtccatcgctttcgcgtcgttttccggaatgaaaaagaattcggaatcaaagtgatccatattgtcaatcaatcccgcaacgtattgatttgcatatccgaaacgttccgccgggacggagccgattgcggacctgccgcttctcagcaagtcccaatattgttctaacgattccgctcccggaaaacggcagctcattccgacgacagcaatgtcttcagttacggcatcacgcttttggtcagtgtgaaccgtttgtacggcagccggaaccaacaatgctgtatcaggttcctccctttctgcaagcagcggctgcccattggatacaagccattcggaaaacgcgtcaatcgtcggatgttcatataaaacagacggatctaagtcctctttgagcgcttgattcatttgctgtaaaagctgcgctaaaatgatcgaatcaaccccgtaatcctgaaacggttcgtctgtttccagttcttccggagcgattttcagctcatcggaaaacagtttcacaagccacgccttcgtatcaataagcagttctctgtctgaatgtttttcagcggctttgccgtttattacggcttcagtctctttttgttttttctcttgacagagcagcctgtcaggatgccattcgctccgatcaatgatagccggcagaacggacgggcggatgttttcagataaaatgcggtccagcaagtcaagtccttccgcgttggacagtcccagcagcccggtctgcttcaggctttctgtgcggacttcacccaatccggtttccttccagttcggccattgaatgctgactaacggatattgatgctgatgagccgccgcgaaataatccatgtacgcatttgccatcgcataatccgactgtcccgccgcgagcgccggaacgactgcagatactgaagaaaataagacaaaaaatttcaaaggatcatttgtgaaaaggctgcttaatgtttgaagcccggcgactttcggttccagcacttcttgtatatcgtcagcagtctttctgataaacgccggatttactgaattaaccgatcccgcacagtgaatgacgccgcctatcggtcccatcgtgcgccggatcgtttcaatttccgctgccgccgcatcatgatcagacaatttcagactgatcaccgccacctgcactccttttgcttcaagctcttcaatcgcccgtatcttctctttcagtctcgtattaacggctgaccgttcatcgcggggaggaatcggctccctgcctgtcagcactacttttttcacgccgtgtttttctgtgaaatggcgggcgcataagagacccagtcccctcgtgcctccggtaatgaaaagcacatggtcttcaggaaacggtgcgggcttatgttctgctcgcttcccgcttggtatctccctgaataaagcacggtatctctgtccgtttcggcggcagatttccggttctgtgcagtccgccgaaaattcatctgcaatctgtttggcaagcgtctgctgatccgtatctgtatcggcatccatgtgtctggacgtcacgttttgatactcattttgaagcattctgtacaggccgctttttgccgctcctgcaagatgaatcgttttctgctgaaatggctccaagccttttgttacatatagcagcgtcagcggccgcgcttgccggcggcttgtatcaatcagagtctggagccggctgatcccttccagtgaagggtcttcgtctccgcatcccgtcagatcgattgcgccatctatgtgattccaatcgctagctgcagtgtcagccgaatcgaccgggagaatgaatgagtcagcgaaatgctttgcagtctcttcggctagctccgctgttcttccatcagccagaatcatgaccgtcttgccgcttttctcaccggccgaatcgatctcacacggaacccattgcttttctaaaagcacagcctcgcgccggtcttctgtttcctgcggtacggctttcggctcaggcagccagtacggctccttcgcaaatgggtaagccggcagactgattctgcggggttttttgccttgatagagtctgtcccagtccatctgaagccctttggcccataattccgctattttggcgtattttttcttatcgaaccatgacctcacaagctgcttcaggtcatcgtccgtttcaaatgctttgatttcttttttagccgttttgatatgggcttcatatatcccttcacccgtatttccgtttacaaaatcggttaaacggctgatcagttcttctctcgaaccggctgtaaccgcaagacggtaatccatcgcatcacgcccggtttgaagcgtgtacgccatatctgaaagattgatattctgattggcttttgcaaattcgatcacagactcggcataggtttttacctgaggcgcttttttcgccgacagcacaaaaatgtttgtctcatcaggctttcggcttccccggtctttcggctgatactcttcgataacgagatgagcgtttgtgccgctgtagccgaacgagctgacacaggcccgccgcggtgctccgcctgtttcccaaggtttgagttcggtattgacaaataaaggcgagtcatcgaaatcaaaatgttcattcggcgtgctgaaatgaagggtcggcacaagctgctgatgcttcatcgacagcagaaccttctggacgcttgctacacctgccgccgccgacgtgtgcccaatattcgatttaaccgaaccgatggcgcaaaattgtttgcggtccgttttttccttaaatacagaagacagggcttctaattcaatcggatccccctgctttgtgccggtgccgtgcatttccgcataggtgatgctctcagggtggatgttgtgcgcttcatacacttggcgctctaaatccatttggcttttcgcgcttggtgcggtaatgccgttggtttttccgtcctggttaattccagatccgataatgactccgtaaatatggtcttgatcggcttccgcatctttcagcctcttcaaaacgagcgcccccgcgccttcgccaggcacaaatccgttcgcactgttatcaaatgctttacattggccgtcaggagacagcattccggcttcacacatgctgatgtatgattcaggcgttaaatacaaggtcacaccgccgacaagcgccatgtcaatttcatgattcaacagcgcctgacgcgccaaatgagccccgacgagagatgaagagcatgccgtatcgatcggaatggccggtcctttcaaattgagataataaggcaggcgggccgccgcgatgctgaaactgttgcccgtcgcgcttcctcctgtctgatgtttgtttaacatcatgccgtattcattgttcataatccccaaataaacgccgcaatttttcccgtttaattcttttgagctgtaacccgcatcttcaaaggctttaaaaccttcctgtaaaaatatccggtgctgcgggtccataagttccgcttcagacggagatatattaaagaacagcggatcaaactcttcaatgccgtcaagcataccgattgatctgcagtatactttgcccttcttgtttaaggccggatcatagtatttgtttacatcccagcgggaaagcgggatgtcgcgaatggcgtttttcgcacgggctaagttgtcccaatatgtctttaggtccggcgcatccgggtacttgcccgacatgccgacgatggctatcgcgtccgctatctcgtctttaggctcccgtttggcctgcaccggttcaggttccttttgaaccgttaatctctccggctcggcaggtgttttctcctgcggggcatgttgctgcgtaagcggctttggacgtacgggaaccgcctgtttttttcttccgcggacagacggctgcgtacgcagaaaatcggcaaattgacggattgtcggataatcatacactttcgttacgttacagtccgtgccgtaccgtttattgacggcctttatccattcaagaccggtaatcgaatccatacccaagtcaataaaggcctcatcaatatctacttcatgccgctccatgtacaatacatcagccagtgcttttgataactcatcatgcaccgcttcaatcggttgttccggttcggcggaagctgccgtttctgacatcgcctccagaatatccgcttctgcttggatcacatgctgcttatgagcgtttaaaggctgcagcatgatgtttgacggttttttcacggcttctgttttctgcggttcggttgctttctcaaggatcggttctgtcccgagctctttttgcaagaaggccgcaaactggcggattgtcggataatcatatactttcgtcaccgtaagggacgtgccgtatgctttattaacagactttatccattcaagacctgtaattgaatccatgccgatatcaataaatgtgtcgtctgcgtcgatatcgtcggcatccatatataaaacgtctgccaaactttcggtcaatacggcacttactttttcagcggaaaccgccggacgggaagcgggctgtacggttcttttcggtttcgcgccgctcaaagactgcagtgtaatgtttgacggtttttctttgacagtctcctcgtgaagagttgttacttcaatgaccggttccggggcggccgccggtgcgatcggcgcagactgtgtttcggccggtcttttgacagctgcatctgctgatatgtcgatccaataactgtcttttgcaaacgggtaggccggaagactgattttttgcggtctgcccatttgatacagcttatcccaattcagcggaaggcccttcacccaaagctctaatacctttgcggctttgcctttttcaagccacgcctcaatggttttttccatgtcctcatcagccgcaaacagcgccatcgtgtctttattctgtttgacttgtccgcggtagagctggtcaattgacttcttgccgcccgtaaattcgtcaagcttctcttcaagctcgcgtaaattgctgacgatcattccgagacgctcttccatcggttcacggccgatttgaagcgtatatgcgatccggctcagatctgcttcccggtaacgcccgctccgcagtgcatcaagaagacgtttcgcctgtttttgaagccgttgctcatttttcgcagaaaggacgatcatcgacggatgaggcgcagcataagccgtctccttatcctcatcagcggaatattcttcgatgacaatatgagcgttgacgccgccggctccgaatgaggaaagccccgcggttctcggcaattctttatttactccgttttcatttatgaccggtcttttccactcttcaagcgtctgctgcactttgaacggcgtactcggaaaatcaatattcgggttaagcgtccgggaatgcaatgacggtgcgagctgcttatgcttcatttgcaggagcaccttcgtcagcccggcgatgcccgccgcgctttcacagtggccgatattggatttcgctgagccgatggcacaaaactgtttatcttgtgtttgttctgaaaaggcttttgtcagacccgtgatttcaatcggatcgccgagtgaagtcccggtgccgtgggcttcgatgtagctgaccgccctcggatcggttcccgcgtcttttaacgcctgtttgatcaccgcggcttgggcgttcggattcggtacggaatacccgtttgtttttccatcatggttcacggccgttcctttgatcaggccgtaaatatgatcaccgtccgctttcgctttagaaagcggcttaaggagtacggcgcccactccttcaccgggcacataaccgtctccgccttctccgaaactttcacatctgcctttgcttgataaaaatctgttctggccgagcatcaaatatttattcggatgaacggatacattgacaccaccggcaaatgctgcctcgcattccccgttccgcaagctttggcatgccagatgaatggctgttaaagaagaagagcacatcgtatccagagccatgctcgggccgttaaaaccgaatacataggaagccctgttcgcaattgatgacggatttccggtcagcgcaagcgattttccgcgcgcctgttcttcggctccgtaaagctgatattcctcgtacatgacgccgacgtaaacaccgacattggcgccaagcaaatcacccgatttttccgtgagctttttgcgcgtgtaaccggcatcttccatcgtttcgtagacacattgcaggaataaccgctcctgcgggtccatcaattttgcatcccggggcgaaatagagaagaattgcggatcaaatttgtccacgtctttcaaaaatcctccccattttccgtacgtcttgccttctttatctttatcagcgtcgtaataaagactgtgatcccagcgatcgtttggaatttcggttatgcagtcagtgccttcactcaaattcttccaaaattcctgaagattttcggcctgcggatatcgtcctgatataccgataattgcgatatcttcacgctctgtcagctgctgatttttccgcgtgtctggacggacttgcgcaaagccttttttgccttcattccgtttgaaaacgggctttactttcgctttctcagacagcgcaggtttggctgcaggggtttcttctgttttcatcccggtcacttccagcagcgtgtcccggtgtgctttcataaaatactgcgccagcgattcgatattctggtactcgaaaaacaatgtttttgataatgagccgaagctcttttccagccggcccgtcaaatgcataatcataatcgaatcaattccgtaatcttccataggcgccttggcatcaattttgccgacaggaagtttggtcacttccgaaagcacttgtttcaagaaatgctccgttttttctgcaagcatgttctctccgcctgctgtacgacctgccgtttcttccgtttcgctgcccttatccggctgatcatccgctgattttttcagaaacgcccggatttttgcggcgtagccttccgtcaccatgacttgggatgtgtttgccgcccacccgcggtataaagcctgaatgccgttttctgtttgcatagggaccatgccgctttcttttgtcagcatggcttccgtttcagcatcaaccgtcatgccgccgtctttccaaagcggccagcagattgaaagggtatgtccatagcgttcatttcgggcttttttacggtttcttttttcactgaaggcgttcataaacgcattggccatcgcataatcagcctggcccgcgcttccggcgcttccggctccggaagagaaaagaatcagaaaatcaagctcaatgtcctttgccgcttcatcaagatgaaccagcccggagactttcggcgccagtacatcacggatttcatctttgtgctttttcagaatatagttgtcttttatcgttccggcgctgtgaatgataccgtttaagccgccgtactgccgacagatgtcagctatgagcgattgaacttcttgtttttccgttatgtctgtttgtttgtacacagcttgcgcgccgagatcggacagttcttgaagctgggcttttttacggttatccaacagagaacgccccgttaaaataagaacggcgtcttttgcatgccgggcgatttctttggcgaataaaaatccgagtccgcccgcaccgcctgtgatcagataaacacctttatccttccacggcttttcggcgccgaactgttcaagccctgtttcctgccattgtgccgtatagcgcctgccgttttcatagcgaatatgcttgtcatcaggatgagcgctgcattcttttacatatcgggacagcgtgtctgccttgacgtccggctccgtttcaatcagctggcctgtcaggttcgggttttcaagcgccgctgttttcaaaagccctgttaagccgcaaaggagctgcgtatccgcttcttgaggcacgacaatctgaatgagctcgcgcccgccggaatttgaagcgaggattttcttcacttcttcgaacgcctgaagcgcacaagcttcaaaccgttcgtcttcactcttatgctgatcacggagcacatgacagctgaagtctctctgtatgctgttcatttgatccgtaaaccggtcagatatcatcacgtgacgggctttgaaatggatcggcgctttttcatgtacagcggccttctcttcccatacgtgttcaaaatatagtgtatctgttttatccgtttcaatttcccgtgcggaataaccagtcattttcacacatacattgccttgttcgtcacatacatcaatatccagcttctgcacggcatcttcaggcttgctttcgccgctgtacgcaatggaaacccacatattgcttttacagcttttcaacacatcaatctgttcgagagcaaacggcagcatcggccgtatgtcagtcccgtctctgtcaagcattaacccgattgtcgcgtggaaggccgcatccaaaaggctcggatggaggacaaactgatcttttgtatgagaaatagatgacgggagtgagagcttcgcgagcactttgctgtcttttgcatagatttccgtgaccgctttgtgagcatccccgtattcaatccccatttgtttgtatgcctgatagcaagcgtcaggtgtgatcagacggcgtgactctcttaatttgtcaatctcgattttggccggttcgcccgctcggacaaacgctgcgcttccttgcgcatagagtacgggctcttcttccgaggaagccgattcactgtaaaccgtaaatcccatctctccattttcttcgtcataaaggcggagatacagttctgcggactcatctgccgctgtaaacggacgtatccatacaacatgtttcagacggactgttccttcttccttcgtttctgccgcgtgttcaacggccgcccggaccatttccagataagccgcgcccggtaacgtccgctcgtttttgacgacgtgatctttcaggaaaaattctccgccgctaaacgaggaccgaaaacggacgcctgacatgtttgatacattttcatgcaggagcggatgcagcatgcctgcatttttttgcggcagcgattctcttttctccgccttcggcacccaataccggattttttcaaacggatacgtcggcaggctgatccgattcggtttgttttcaccgtacaagagattccaatccatcgttcctccgccggcccacttttcggcaatcatccccagactcccggaagaaagccatttatgtatcaagtccggagcaagctctgcctgtttgcttttatcagctcggttccgccagcacccgctgaccgttttacccgccagaaagccttccagccgctctttgagctgtgtcatattctgagcggtgaacgcaacccgctcctccatctgttcacggccgatctgaagtgtatacgccgcatcctcaagcggcaggccgggatgaataaatgcagacagcttcgcaacatactcttttagccgttcttcattccgggctgaaaccgggaaaatgaatgtctgttcttctgccggttcagcatttgttccgtgtgattcttcagggataaattcctccagaatgagatgcacgtttgaacctgtcgccccgaaagagctgatgcccgcacgccggggatatacggtttcggttccgttttccgtcactgatggctgctgccatgcttcggtatgatgctggacgtaaaacggtgattgttcaaaatctaaatacggattcagctcctccgaatgaagagacggcaccaaagttttatggtgaagctgcagggcaaccttgcttaagccgctgatgcccgcagccgattccgcatggccgatattggacttcactgatccgatcgaacagaactgtttgtcctgtgtgtactggcggaacgccttgacaaggccttgaacctcgatcggatcgccgagagaagttcccgtcccgtgcgcctcaatataactgaccgtgcgcggatcgatgcccgctttgtccaggcattcttcaatcaaatcagcctgcgcgacaggactcggcacggaaattccgctcactgtccccacgtgattgacggcactgccctttatcaccgcataaatccggtcgccgtcttttaccgcctctcgcagcggttttaataaaacggcaccgattccttcagccggtacatagccgtctccgtctttcccgaatgtatgacaaaccccgtctgttgaaaacatgtcccataaaccgtatgtcagatatttattcggatgcagcgacaaattgacgcctccggcaaccgccgattcacattccccgcgccgaatgctttccgcagcaaggtgaaccgcagtcagcgaagatgaacagaccgtatcgaccgccatgctcggcccgtgaaaattgcaaaaatatgaaactctgtttgcgatttgcgcataattaagagaaagcgggaatacatgatcttcagaagaagcttcagccccgaccaacgtataatccttatgcatcacccctgcgaagacgccgacgcgctgtctcttattccgtccgcgcgattctgcgagcgacttcggcgtatatccggcatcctcaatcgtttcccagcatgtttgtaaaaacagccgttcctgagggtccattgtttcagcttcccgcggcgtaatccggaaaaattggggatcaaagcaatccggatcatcaataaatccgccccattttgaaatgctctttccggaaggcgactttacattttcaaaccggcgccagtcccagcgagactccggaatttcggtgacacagttttttccttctttcaggttttcccagaattcatgaatattttcggcctgcgggtagcggccggccatgccgataatcgcgatatcttcatcttgcggaacactgcttttccgtcttctctctgtttgcggctcaaccggcttctccatttttgccggagacgcgctgaaatggctcccgtactgctcagtcaggaaagctgccagctctgctgccgtcgtatattcaaacagcaaagtcggagaaagggtttcgccgattttttcgctgatcgtttcgacgacgtcaagcagtccggacgatgtcagccccatttcatagtagccgacttgagaatcaatctgttcaagcggcttgccgattttttccgccatcagattcatgacataccgttccgcttcctcatgcgggtgtccgccttcaagcgatgccgcaacttccggtaaaccggctttttcaggagatttctcagcagtctttcgttctgtattgatcagctcggcatcccgcacgagcttgcttgtgaaatctttcagctcggctacttttcggccggatgcgttaaaaaactccagtgtaatgtaaatgagctccttttcctgccgaagcgacgaacgtttgattctcgtgatgcagccggcctgcaaaggttcggaagctgtaaaagattcgtagaaaagaggcagaaacagcctcttttccccatttaacagcgatgagatcaataggtttgcgccgacgccgcttccgtcaaggagagtcggatggaacaaaagccccccggcctgtcccatcgcgtcttttccgagcgatacatcaaagatgacgccgtcccgctcctcaaacacttctccttctgctttcatatatccgctgtgaaccaattcctggcttctgcattgtgcatacagctcatttaaatcgatggtgcgttccgcctcgcgtttgacagagtcaagatcaagcgtgtcactgaaaattgcgggtgccgtctcgtgcatttccgctttgacgtaaatacgttcttccggctgtactcgtccgccgctgacctcagccccttttgcggtaagtttccagcgcccttcttttacctttgtacattcgaccgtaagcttgacggcgctgtcttctttcgcaataagcggctgatatatggataaatggcgcagctgaagcccgtcgtatgaatagccgcgctctttgaaaatctgataaaacatatcaatataagccaatcccggaaggactttttgtccgtaaacgtcatgatgtaaaataaacggatttttcagcgataaagtgatttgcttattgaagttcttcacgttaaacctccacttcataggtatcccagatgtttgccgcagctttttcgttcgtttcttctttgctgtccggcgaaatcagccgcttatttaatgcaggcggtgttaaaggatggcgcttgattcggcgcccttcgtcttcctgccacgcttccacaatgacgtgggcgtttgttccgccgtcggcaaagcagttaattcctgccgccggtattggtgacggccagtctgccagagtgcggctgaactgaatattggccttttctctatcaaaatgtgtgttttcatgctcgcctgataaaaacggaataaagctcttttctttcagcatgagaacaacttttatgaaacttgcaattccttccgcgcaaagcgggtgcccgatgttcggtttcacagatccgattccgagcgggccggcgtcttttgaacggtagacggattgaatggccttcagttctaacagatccgtcacgaccgtgcctgaaccgttcgcttcaatatgagtaatgtcttccggctgttttccgcttttttcaagagccgtcttcatgacggatttttgcgcttccagactcggcgtagccgggccggccgttcttccgtcattattgacggatgccgccttcactacggcataaatagaatctccgtcttcaatcgcctgagacacggtttttaatagaaccattccgacaccctcgcccagcacgactccatcggcgcgttcgtcaaatacatggaacgactgcgctttacttaatatgccgcgctgttcaaataatttatgggtttcttctgattcaaacaggctcacgccgccgacgacggccgcttttatttctcctgttacaagagcctgcacggccatattcattccgactaaagcagaagaacaagccgtatcgaggacaacgctcgggccgcgcatatcaaagtattgagagagattggcggccaaataattctggccaagcgcgacgatcgggtttttcgcgtccagcagtttctcttcacccggtctgtgacggctgcgtccgccgagatacacacctattgcttctccctttatctcatccggcgtatagcccgcgtgataccacaggttaagacattcttccagagcggccaaagcttgagggtccattgcctttacatcttcttcagccagtaaaaagaagtccggatcaaattgatgaattccatcaagcattcccgcgtaataaggcgtcttcaaaccccatcgctcagccggaacaggaccgatagccgaacggccttcagccaaaagcgaccagtatgcctctaaggaagccgcccccggaaaccggcaggacatgccgacgaccgcgatatcttcccggtgaatctgtttttcggccggctcttcttgcaccttaacggcttgtgtttcaattaccggctcagccggcttcttcataacaggctccgccgccgccaaatcaaaccgttctgacaaaacttctgtatatccttcgagaagccaatttgcgaaagattgaatcgttggatattcatacagaatggacgggtcaagcgatgccgagagattccgattgatccgctgcagaagctgggcaaggataatggagtccactccgtaatcttggaataatacgtctgtctcaagctgatcctggtcaatccgcagctcttcagaaaataattctttcagccattcttctgttttccttgttaattgagcgttgtctgcggcagtatcagcggttttttccgccggttttaccatagccggactcattggctgatcctgcctgctccgccgcaggaatcgctccggcttccacagcttaggattcagaacggccggcagcaccgggccccttgctgattcaataagtatgccgtcaaggagctgtaatccttctgcattcgtgatgctgtatagcccgctctctttataagctttgttcgttacttcgcccattccggtttctttccagttcggccactgaatgcttacgatcggcagctgctctttgtatgagtttgcaaaatagtccatatacgcattggccatggcatagtcggcctgtcctgccgaaagcgccggtatcgcagctgacacggaagagaacaagacgaaaaacttcagcggctcttcgctgagcacactgtataacgcctgaagcccgtctactttcggctcgagcacgcgctgtatgtcttcatcggtttttctgatgaatgcgagcgtctctttatcggtcacacccgcgcagtgaatcacgccgccgataggtccgagcgtctgttttatctgactcagttcctgtctcagcccggcttcatcagctaacgggactgacaataccttcacttgtacacctttggattccaagtcgagaacagcttcaattttcgcttttacagaagccgtcaccccattcagtccgcctgtccactcacttcgcggcggaagggtctcacgtcctgtaagcaccagttttttcactccgtaatgttcggcaaaatggcgtgcgcataaaagaccgatccctctcgtccctccggtgatcagaagcacatggttgtccggaaaatcaattctctcgccttgcatattcatattttctgagccgctcaatacggcgcggtagcgcaagccgtccctccggcaaacttccgcgtcatcagtacgggcatgaaactcatcggcaatctgcttcgccagtttgtcatcagaaagcgctccttcaaggtcgagatgccttgaagacagatgaccgtactcacatgccagcattctgtacagaccggcccgttttgctcctgttgtttgattggcctctttatttaatgactcaaggtctttcgtgacacaaagcagtgttatcccttctttatgcccatgctcaatcaattgctgaagccatttgataccggtcatatctccagaagcttcttctttcgctgcgccgagaagatcgatgactccgccaaacgcctgccagtcatatacaccggtaaggtctgatgttgtgataatacggtgattcggcatatgcgctgcgatctcttctgcgagattgatcgtgtccccgcctgtcaaaatcgcaacggaacgtgggcacggttcacgcagttcgagcgggctcggttcccattgtttcgtcagaatacgtttcatccgttcctctgtatggaccttatttttgtcaggattctccggtacccaatacgtgtcttttgcaaacggataagacggtagactgagtaaacgcggcgtacccttttcatacagccggttccaattcaacacaccgcctttcacccatacctctgccagcttggcgaatttgccttttctgatccaggcgtcaatgacgatgtccatatcttcatctgccgtgaacaaggcaaacgtatctttattgcggtgagactggccggtatacagcccggcgatgtttttctcatttttcgtaaatgcttccagctttgtttccaattccgccatcgtcgctgcaagaatggccaagcgctcttccatttcgtcccttccggtttgcagcgtataagcgacgcccgccaagtcttgatctgtatacggcgtttgacggatcgctttttgcagctgctgcgcctgttcaaacaatttttcttttgatttggcggacaaaaggatgattgccggattttccgggctatgctcaggctgagcggctgctttcgggacatactcttcaatgacgatatgggcgttgaccccgccgatgccaaatgagctgaccccggcccggcgcggaatggcatttccgtttctatcttttgctgccgtccattcctgattttcccgcacgatgtagaaaggactgtcatcaagctgaatgtacggattgatcgtctcgcaatgcaggcttttcaccagcgttttgtgcttcatttgcaaaagcactttcatgacgcctgatactcccgcggcaagctctaaatggccgatattgcttttgaccgaaccgatgccgcagcggtgaccggagacttcaggctcttgatttgttttcgccagctcgtgaaacgccgctttcagaccatttatttcaatcggatcgcccaattccgttcctgtaccgtgcgcttcaatatacgtgacggtgctcgggtccactcccgctttccgatatgctttcaccaataaatcagcctgcagtttcggattcggcgaggttaacgtattcgcccggccgccgtggttttcagccgtaccgcggatcacgccgtaaatcggattgccgtcacgttctgcatctgtcagtttcttcagcatcagaattcccgcgccttctcctctgacatacccgttggcatccttggagaaggttttgcattttccgtctttgctgagcatgcctgctttgctgtagctgatatgcgcttcttccgtcagaatcgtgttgattcccccggcaatcgccatgtcgcattctccgttttctatagcggataccgcccggtgaatcgccacaagcgagcttgaacatgccgtttcaatcggctcgctcggcccgtgaagatttaacaaatagctcaaacggttcggaccaatggaaggaatcatgctgcctgtcgccgcatgtccttccggcgcaagacctgcccttgtgaacaaatctttataaccggtatttccggtgccgataaatacgcccgtatttgtaccggaaaggctttccggcttacagcccgcatcttctatcgcccgccatgcataagtcaataacagccgctgctgcggatctaaatattgggcttcccgcggtgaaatcccaaagaacagcggatcaaattcagctattccgtcgataaagccgccccacttgatattcgttttgttcccttcaagattcgggtcgccatcaaacgcttgccaatcccagcgttctttcggaatggttgtgatcgaatcctttccttctttcaaattgcgccaaaattcctctatatccttcgcgcccgggaatcggccgctgattccgacaatggcaaccgggtccaagcggcgcggctcttgtgccgctgccctagcgttcattaccgttgcgaagcgctttttccgatgcattttcggtttttgggcttttggctgctcttttttcggagactccttcttcttttcgccgaaacggcccggatgctcttttgccaaatatccggcgagattactgatcgttccgtactcaaagaaaatcgtcggcgccagctccagctgatacgcttcatttaattgattcgtaaagacggtaaaggatacggaatcaaaaccgtattcactcagttccgtatctgtctcaatgtcctcacggtcaacttttaaaatgctgcttaccatggctgtcaaagcggtgtgaagcgcttgaagagattcttctgcatcgtgtttttcttccggctgaaaaggaaggccggcttctgcctcatccgtcaaatactctgctaaactgcggatcgtcccgtgttcgaagaagatcgtcggcgccagctccagctgatacgcttcatttaattgattcgtaaagacggtaaacgatacggaatcaaaaccgtattcactcagttccgtatcgatatcaatctcgtcttggccgacttttaaaattgaactgaccaatctgataagcgcaccgtgccatttgtctcccgaaacggcggatacaggctctattttctccacctgcggcttttcagtttcagaaacggacaggaacgactgttttaattttgctgcgtgtccttcagctgctaaaagctgcggcctttcctgagccattccttcataaaatgcagccaggcctgacgccttttgaagtggaaccatgccgaaagcttttttcatcattctctccgtctcgtctcccgcctgcataccgccatctttccacagcgtccagttaaaggcgatcgtttttccgtgccgcaggccattctccgtaagggattgcctgtaagcggcgtatgcatccataaacgcgttgccggcggcataatcagcctgcccgacattgccgagaacgccggaaacactggagaacaatacgaaaaagtcaagattgcagtctttgctggcttcatctaaataagcggttccgatgactttcggatcaagcacttccctgaactcttccttcgttttttgcagcaggaagcggtcttgtatcactcccgcagcgtgaataattccgttaagctttccgaattccgccgtaatctctttgatcagcgcttcattttcccgccggtctgccgcattcagctttttgtagacgacatttgcgccggagtgctgaagcatagcaagctcacgctgtttggcttctgccagatttgagcggccggtcagaatgattttcgggtgttttacgcgacctgcgatttcttttgcgaacatcaagcccaggcttcccgcgcctccggtaatcagatatacaccttcgtccttccagacgatgccgccccctgcgggatgcatttcttcccaagccttcacataccgtttttctcctttataacggatatgtttatcatgcggccgatgactgtcgtttttcagtttttgagcgacagccggcatttcgccgattgattccatttcgatgagctgacagtcaagttttccgtattccagctcggctgtttttaacaaacctgttaaccccgcaaacaattgctggctgccgtctgctgagataacggtctgaatcagaatgcggccctgccttttttcgctgatgatccgccggatgtgttcggcgattgtctgcgcaaagctttggaagcgttcagcggctgtttcaccctcaccttctgcaatcaacagttcggcgtctttcaggccggatgccgcttcatcttttatacggcaggcatcttcacaaagtatgatcaaatgctcatcagcatggacagaagctttctcggatgcggcggcttctttccagaccggtgcaaacaagaccttttctgagcctgatagccgctgagccgattctgcatcgccttcaagcactctcgtagagaatcctctcaccttcacgcaaagcgctcctgtttcgtcgaacaggtcaatgtcggctttctgcacggaatcaccggtttgatatccatcgctgaagcgtgcatgcgcccgcatagccggcgtgcatgctttgatgacttcaagatattccagcgcaaacggcagaatcagcttttgtccggaaaactcctgcataatgcagatcgtcgccgtctgaatagccgaatcaatgatgctcggatgaagcgtaaattgttcgttcgtgtgagaaacagaatccggaagctgtatgtccgaaagcacttctttctcgccgataaaggcggacttaatgccttggaaggcttttccgtggaacatccccctgctcctgccttcccgataaaaggccgccggatcaagaatatccgctttgcatctgttttgtatggcagaaaggtcggcctcaggctcttgttcagccttaatgatttcggcccgtccttggctgtgcagcacttcttcatcctcagcgtttacgctgtatatgtcatatgagatgatgccgtcctcttcagggaacagcgcaatatggacctggcgctcttgtccgtgaacgacgatcggtttcatccagaccgtatgatggagcgttattctgtcttggtcttttaaaaagccgccaagcccccgttttaccgcttcataagacatttccaaatatgccgctcccggcagcaccgctttttccctgaccacatgatccttcaggaaaaattctgagcctgtaaaccgtgagctgaaccgctgaacggccaaatctgacgtattttgctgcacgagcgggtgtaaaactgagactccggtgtgtgcggcagatgtgttcttttctgcttttttcggccagtacggctcctttgcaaacgggtagaccggcacgctgattcgtttcggatgcttgtctttgtaaagcttgtgccaattgatggcgacgcctttactccacatttcacagagcttcggtccttttcctttcgcaagccatttctcaatgagttcagcgctgtcatcatcatcagaaagccaggcaatatctttcacctgctgtttttctcctctgaagcagcctgttacagccggcttatcattgataaaatcggcaagctgccgcttcagctccgcagtgccgcttgtgataaaggccgcacgctcttccatcgcttcccttccgacttggaacgtgtaggcaagatcagcgaggccggcgtccgtttttctttccagaaaagccagcagctgttttgcgtactccttcagacgatctttttttctggcagacaacggaatgatgaacggaccggcagcgtctgctgcttcggatgcatccggatattgttcaaaaatcgcgtgtgtgtttgttccgccaagaccgaaagagcttaaagccatgcggtgcgctctgttctcacgggttaactctttcttttctcccgctacgtaaaacggagagtcttctaaatgaagattcggattcggctctttgtaattgatgctcggcgcgatttcctgatgatataagctcatgacaaccttgatgcagcccgccattccggccgctgtatccaaatgcccgagatttgttttgactgaaccgatgccgcagtattgttttttatctgtatatcggccgtacaccgattgaagtgcggacagttcgatcggatcgccgagttttgttcctgtgccgtgagcttcgacgtacgcgatcgtttcgggatggatgcccgtctgatcaatgaccttctgaatgacctcagcttgtcctttgacgctcggcgcataaaatccgaccttatccgctccgtcgttattgacgccgattccgcgcagcagcgcataaatatggtcgccgtccttaaccgcatcagacgcttttttcaagagcacggcgccggccccttcaccgccgatcattccgtcagcatccgcgtcaaacgctttaatatgcccgtcgctcgaaaaattcagccccggctgatgaacatacccggcgcttgattccgtatgaagggtcgcaccgccgacaagggcgtacttggcttcgccggactgcaggctttgaaaagccgaatgcaggccgattaacgaagatgagcagttggcatgaacaaaatagctcggccctttcaacccgagtttatgagaaatcatcgtcggaatcgtaccgctttgggcaagcacccatgacacgtagccatccggcgtttccagctgtgctgtcgtctcccccggcagcaggctgcggtaagagttcgtgctggcagacatatacacgcttgtttccggaatttctttggagatataccccgcatcctcgattgccttccatgaatggagcaaaagcattctcagctgagggtccatatattccgcatctttcggtgaaaagccgaagaaaccgggatcaaacatttctttcccctctaaaactgatttagccggaacgaagccgggatgatcagccagttcttcagaaataccgaatcggcggagctcttcttttgaaaagaaggtgatgctttctttgccttctttgatgttattccaaaattcataatgatctttcgctcccggaaactcacaggatataccgataaccgcaagactgtcctcgtaataatcgggaaattctcccgccgggtgttcccggtcttctgcattcactttcttttgcggtacaggagccaaaacggcttctttcggtttttgttcagcgatataccggctgatgtcttttaccgtcgcgtattcaaacagctccgttacactgaattcacaatccaattcctgcgtcatccggtcagtgacagtcacggcaagaagcgaatctccccccgcatcaaaaaagcggtcatcaagctctatatctttgcttttcaatacatcctgccaaatcgccagcaccgcctgctggatatgagatgatgaaaatgtttgtgtgtccggctgcttttccgtcagatcgcgggcagcaagaagcttgcggtccacttttccgttcggtgtgagcggcagctcttcaagacggataaacgaagctggcgtcatataggccggcagcgcttgtttcaaatgattgcgcaattcctttgcagacggaagcggctctccgtttttccggatataaaacgcgcaaagcttctcatttccggagtgattgttcacaaccactacactttcctgtacggccggatgggcattcagcctgctctcaatatctccgggttcaatgcggtagccgcggattttgacttgggtgtccatccgtcccatgtattcaatgcggccgccgggaagaaaacgcgccatatcgcctgttttataaagctttgatcccagttcgagccggtggctgacgaaagctttatctgtcagctcaggcttgttgaaataccctcttgccaatccgtctcccgcaatacaaagttctcccggcaccccttctaaaacagggttgagaccggaatccataatatacacgcgggtattggcgatcgggcgtccgatcgtaagcgcgctctcattctccgttatccgctgcaccgcggaccagattgtcgtctctgtcggcccgaacatattccaagcctcacttttcgtatcgagaaactgctgcttcaattgttcgctaagggcctcaccgccgcaaaggattttcacattttcttcatttgaccatccggaatgaaagagcattttccacgtaaacggcgtcgcctgcatgatcgtcggtttgtactcttgaatcagctctttcagcttccgtgcgtcttttgtgacttctgtcttacagatgttgcactccgctcctttgattaaaggaaggtaaagctccagtgccgcgatgtcaaagcaatatgtcgtgacggcaagcagtttgtcttcggacgaaagccccggttcattcgccatcgagagtaagaaattggtcagcgcccggtgcggaatcatcacgcctttcggtttgcccgtgctgcccgacgtgtaaatgacatacgccagatcgtcaggtgtcactaaccgcttcagcgacgttctttccgcggctgtactttcaatacgagaccaatcgcggtcaatggcagttgtctgcacgcctccccagttcaaggagtgctctaaatcagctgtcgtcagacacattgaaatcctgctgtcggtgatcatatattccaatctgtcagcgggataagaaggatcaagcggcacatacgctcccccggcttttaaaatgccgagaaggccgacagccatatgcaatgatcggtctgtataaatgccgatgagatcatcagggcctgcaccgtgcgcctgcaaatagagcgccagcttcgtgcttttttcatcaagctcacggtacgtcagcttttgctcttcatacacgaccgcacaagcgtccggcgtttctgccgcctgacgttcgaataattcatggaagcaggcatccggatattcacggcttgtctcattccaagtattaagaatcatgtgctcctctctttttgtcatgagagaaacgttctcaagcggcgtatccggattcgccgtcaaagcttcagcagcctgtacaaattggctgaaaagtctggccgcccctgcttcgtcgaataattcggtgctgtatttaatcgtaagatccatgcctgatgcttcttcccacatttcaaatacaagatcatattccccctcttgatgaatgtcttttacaaactcacaggagaattccttgtattcatcaagcatcgattgatagctggaatgctgcagaaagttctgatagaaaaaggcattgctgaaaacaggcgaaccgttctgccggggtttcgcatgcacatcacgcaccattttcggaaacggataaaaggagtgatccagtccgtccagaacggcatcctgcaccttttgaacaaagtcagcaaatgtttcttttcgtccggctctgctccgtatgggaagcatgttgaggaaatggccgaccactcggtcaaaacgttcttcgggtctgaccattgcaggcatgcctgtcacaatatcttccttatccgtatatttgcttaaaagcaccatgtaacagctcagcatgacggtagacaaatgaatcgaacgggatgcggcaaacgccgttatattattcagcagccgttcgggaagacggcgtgtcagtgtatcttctgtaaactccggaacactgctgtccgtgcgcatcggcggaagctgaaggtcaggcagatcgccctcgagctgtttcatccagtaagcgcgggcagctttgctttcttcacccgctaaataccgcttttcccaagccgcgaaatcgggatgaataccgggagcggcagctgtaaactcttcttttccctccagcagcgcctgataatgatccagcagactgtgaataaatgtaatggatgaaatgccgtcaaacacgatgtggtgaatgaccgtcaaaagataatgttcctcggcggattttgaaagcagctgcacgcgcagtaaaggtccgctttctttgacaaacggctctttcacttttttccgtatcagagcggatatttgtgattcattgacgtcagaaatatcttcttccgagaatacaaaaggatctgccgcttctatgaaataaaacccgccgtctgtttcattcacggcgcttttgagcatcggatgctgctttaatacgagctgaaacgcctgtttcagtttctctttgtcgattccggatgtgaatcggaaacagagcgggacatggtatgcagtcgtttcaggcgacattttctgcaatgtccacagccctttttggacttctgaaagcgctggcgccgtttgccgtctctcccgttctgccggcggttcggctttttggggatgatggtccgctgacatgtttgccgctttttcagcagtataagccgctaaagcgccaatcgtcgggtttttgtgcagctctcttgccgtcagccggatgtgatacgttttttcaattgatctggcgagtttcatcatcttgatggaattgacgccaagactttgaaacggcgtatttggatcaacgagctcatccgcgatggaaagttcctctttcagaaaacggataaaatcccgttcaatttctttctctgcagaagccgtgtctgaattgctgccttcttgtctgttattatgtaatgaatcaaattgcccttgttcaaatgaatgtttcagctgagtgcgctggattttcccgatcgccgtcttaggaatgtcttcttttgcgaccggaagcagataatcaggggtaacgccgattctctgtgtcacgtgctggtgaatgtgatgaagaagcttcgtcatgcggttctcatccaacggaacagatgtcacaaagaaaatcgccagctcatctgtcgtgctttgattcggccggacggcgcatgccgctgtatatgacgtttcaatttccggcaattcctcaacggctgattcaatggcatggctgtaataattcacaccgttgataatgatggcatctttcgtgcgccccgttatcgtcaggcggccttcacgcagaaatccgagatctcccgtttcaaaccagccgtcttctgtaaagacactctcatttaagtccgggcgctcataatatccgctcgttacagtcagacccgacacttggaagcggccgatttctccttcttccaccacttgattgcggtcatccgtaattctcatattaaatcccgggatcggcagaccgatctcgacgaaacgatcgtcgtcactcgtgttttccaatgtaaactcatctgagaaaataacgcccgaagacgtttcggacattccccatgcgggacggatggcattagccggcagaccgtgcggctctaaaagctccataattctgcgtccgactttcgcaaccgcggcctccccgccgttcagcatgtaacgcatggaagataagtcccatttccgcgtttgaatctcttctgcaaaatcagcaagcagcccaaaggcaaaatttggggcccacgtgaccgaagcgcggtaatgatcaatcaggtcgagccattttaaagggtccatcaaaatggattcgctcggtatgttgatttcctcacatccgagataaacatcacgcagatgaagcattccgatgccgccgacatggtcaaaaggcatccagttaaacgtgacatcctcacttgtatagccctgcatctgaatatttcctttgaccatgcagacgatgttttcatggctgagcatcacggctttcggcgtgcccgtgcttcccgaggtcaaaagcagcatcgccaaatcttccggacggggatgatgacagtccgtatccatttcgtgcgcactgagatcttctgccgccaaagcgcaaaacccggaaagctcctgctcctccgcccattcagtcatctccggcagcacgtcacggcttgtgatgacatacggctgattcaaaagcgtccaggcgtctttcagtttttgcgtcccgctgttcatttctgtataagccggagcggccgcaagcggaaccgggatcgctcctaaaaaaacacagccccaaaaagcaggaatcaactgggaattgtcactgagctgtaatatgacttcatcctgagccttcactcctgattggcggagccctttcacaatcgaaagagcgatctttttcaggccgctgtaagtctggtacactttggtgccgtcaggctgtatatatgtgatgcccttttgatctcccgctgccgcggcggttttgtgcaggacttcaggaatcgtcatcggctgatccgctgaaagccgcaatgattttccatagctgacagatggcttgagtaacccgcttgccttcatatcacttttcatagagctgcctccatttcatctgtatgtaagatgtatgtcttatactccgtacatcgtcgtgattcgttttttcacttcatcatcatgaaacgtctcatcgtgcatgattaactccttctcaatgacggccggaagctgctcgcgaaacggcgtcactaagtgccttttcaatgtaattaaagagtttctcggtttttccgcaagctcacgggccaattcctgcgcatagtctagtacttcctgccgaggaagcaccggaaaaggcacccctcttttctccaggtcaccgccgcggtagtggccgccgtttaacagcatttcatggccgaggcttgccccaagcttctccggaacgataaaggtagcgcccattccgggggtgaaaccgtatttcataaagtttgcggtatacacgctttctttgcttaaaatgacaaaatcactgaaaagccccatgacaaacccgcctccgattccgtgtccctgcatggcggaaatgacggggatatcacattccagcgccaaagagtacatgcggtcttccgtaaacttcgtgatgccctgctgaatcctgagcaggccttcctgtgtgcctccggaagcaaagtaatggccgtaccctgttaaaatcacagctttatagactgacgatttttttatacgggtgaatgcttccatcaatccatccgtcagttctttggagaaggcgtttttatgggctttatcctgcattgtcacttggataatatccggttcaatttcgagcagttcaactgcggcgttcggcatgatatcctcctaactgttctccgtttcccaaggaagccgccccgtttctgcataacggaagatggctgattggttatccggatctgaaaacatcgcttgattttcggctagagcaatggatttcgaacgatgaacaaggtcgtttaaggaatccatgtattgtttatagcggatgactgcttttttcgacagtgggcggaggcgcagcaaatgctttctcagctctgttgctgagtccgggacgcatacgtcacaaagtccccattcaagcgcctggcgtgccggcacgggctttgtcatgatcgtcatataatgcgccttttgaaatccgattctttgaattaaaaacggcagaacgcaggccggataaagtccgaataacagttcagataaactgaacgaagcattctcctctgctatgacgatatcgcacgcggcggcaaaaccgacacctcccgcatttacttgtccgcggacgcgggcgattgtgatgtacggcccggattttaatgccagccacaaacggtaaagcggctcctgcgattccgcatgctgcattccctgcctcattctccggtacatctcatcaaaatccgccccgaaacaaaatacctccggctgcccttcaagcactacggaggtcacggagtcttcacattcagaaagaacatgcaggcattcctccactaaacgctcattaatcgtattgttggcttcaggccgatcaaaggtgatgaagcagacattttgctgaaaacggacgtttatcgtttcataggtcacgatatccacctgtatttccgatgaaattccgtgatttcttccaaatataaacgagggctcccggcatgatggtctaaaatgttcggaatcatattcatatccaatttgacattccgggtaccgaacttcaccagaccgctgcctttaaacagttcttcatattcttccatggacagcctgtacctgttgttcagatgctcttctattttgaaagaatgctgccgcgcttgcccttcaggcgtcacaacgccgctgtaaaattccgaacagcatccggagccgtaggagaaacagccgatccgcttagaagtgccgaatgccccttggtcaatcgtgcttgcaagagccagtaaagaggctgcccccataatgtttccgactctttggcagtagcggagccccggctctactctggtttgaaaatcttgttcgatctcagcgtttttcgcttttgcaagcttgcgcatcatcgtccggtgggcccctttgaccatgccgccaaacggtgtatggaaggcaagatagtgaaacgtctctttgtagtcagcgcccggcacacggtttttgtactcgcgaaatgtctgttcacagcaatcgaggtaagacatcaatgacaaatcggcgtcaccggcttcactgtccgggatcggacggcatgtatccatcacctcatagccgtagtagccgttggcgcccgcatccgcctgaaatacgattggattttcaccgatcaataaggcgacggcacccgctccagcgctcggttctgcgtaagaccaatcctcgcttaacgcatcgccgccttcggcaattaaaaaccgggaaatatccgtcgcgacgacaagcgccttcgctccgggggatgtctgcgacaaaataaagttaagcgccatctgcaaacccgccgttcctgaataacaggcttgtttcagttcaaataaacggcagttccggttgaggcctaagtaatcatgaatatatgtactgagtgattttccgaagtcgatgccggactccgagcaggtaatcagcagctcgattctgtctttttcagcctctgtcaatcggtcgataatcggctttgccgcgttaacgccgaatgtaacggggtcttcgtacggaagcgccaccgctttttctttcatcagtaaattctcaaatctggcagggtctaagtttctgtactccgccagctgcatgacatcaaggtatgctgtcccgccaaacacatttatcgcttctattccggcagccgccatgaacttcgcctccaatatgaattttgagtttccgattatttcaccgttttatcagacagcctgtaccttttcataaagctttgccgccaattcgccgatgtttgacactcccgtcagctcaacacgcgggatctgcagtgataattcttcaagcatcatcgtgataatttcggcgcggtccactgaatccgcccccagatcaactaaccggtcttcctgcgaaagctgttcgccttctaaatcaggtaaaacctcgtagattgtgttctgcagcaattcaaagattctttctttactcattgtcagttcctccctgtttcatcttttatgaatattccatgttttcaatctatcatttcgtcttgtcaacacgtttgcaaaaatgaacctaacttctgattcaaaagcgaggccgtctcttccataagccgcatgccgataccatcggcatggcggtttttccaggactccagctccgtacctttcacccattgattaaaggcgcctaatgccgggccgcaatgaatctggaagtctaccttggcatccgggtctcctttaatcgccgaagcagagctttgcctgaaataccatttgaatatgagcgccattttctgtttcggattccgttcggcttttgaaatgtcttcattcgaataatgagccttcactttgtcataaatactgcttacacttgccttaaaatacttctcttctatttgtctgagtgtcttttcatcaatttcttcaattgagcggtgacgctgatacagttcatgcagcttagaggcgcgggtcggaaagaacagccctttctttaatacctgcaccttgctgcctgattcaaacatatcgccggccggcgcgtaggccgtgtcctgtacattcatctgctgcaggaggtcctttacgaggccgctcgtcgctgcctcaacggtgcattggttaatagatccggtcacaataaaatcagcgccgagcataaatgcggccatggcagcctcgggcgttccgattccccctgcggctccgatgcggacagttttgccgtatcggtattttttcatcatgtcatctcgtaaacggatgatcgccggcatgagactgtaagcaactccgccgtcagtgtggccgcctgaatcagcctctacgcagatgtcatgcgcaacgggtatttctctcatcagacttgcttcttcagcggtaattttgttttcggctgcaagtttctgcagaatgtgatcaggcgccgggctgagaaacgcttccgctacttccggacgggacagcttggcgataatccgctgacgcgctattatttgtccgccggcaccgcgttttaaccccttagcgcgaaaccttactaaagcgggagtaaccgttaaaaacgctgatgcttccaagttctgaaccccatgcttcagtaaaagatcaatcattttttcttctgaatctgtatgcttcatgttatgtacaacatttatgccgaaggaaccgccgtcacgaagctcatgctgaattgacaaaatgacgtcctcaacgtgcgcgatgttcaaaccgcccgttccgaaaaagcccatcattcctttttcagccagtttgacaaccatttctttcgaagaaattccgcggtacatgccgccggccaagtaggcgtatttcaattgataatcgcgcttaaactcttcatttcctaaagacgccgccgtaattgagctttttccagcctcagccgggactttgatttcatctgttatcggctccgcttcagccgtaattctttgtatcagccccgtcagcacttttccgggaccgatttcctcaaagctcatgttctttcttcccattaagaaacggatgctgtctgtccagttcaccgatcccgttatttgtccggtgagtgtctctttcagctctctctgctcatagggtcttgccgtcacatttgaaatgaccgggatggacagcggcttaaaatggaaagattcaataaaccgtgaaaactcttccttcgcttccagcatgtatctggagtgaaaggcgccgctgacatttaagcggtgaaccatttttacgccgtttacggcttcaaaaacggatgctgctttttcaatatcttctttatatccggaaatgacaatttgctgcggtgtgttcatgttggcgatatcaatcatatccaagtgattttctcttaaaacatccgtcacctgctcatgagtcaggccgatcaccgctgccatgccgcctccttttgcgcggctcatcagttcgcccctttttttgaccaactgtaagccttcttcaaaatcaaaggcgcccgaagcgtataacgcgttatattcgcccaaactgtgtccggcggtaaaatccggtttcaagccggtttcttctgtttttttcaaataactgagggcattgacgacatagagcgccggctgagtgaattgagtctgattgagacgttctccgtcccggcacagctcctgaatggaatatccgagaatgtgatcggcctttgcggttaattcaggatagcggccgaacaggtcctcccccatccctattctttgcgagccttggcctggaaaaacaaagctgatcatcttacagtctccttccgggcggtgataaaatgctgtcttctatttgctgcaaatgtgtttgttctttatgaaacggcgtcataatggcacggatgcgttcagccgatcctgcaggaagaatctgtttggcaaatgcggccaatgttccggaaggcccggcatcaatatagaatcctttttggcggctgtctgcgaattgaagcgcttcgcggaatcgaatcggctttcttacgatatcccagaaaaagtccgcttgtatatcggtctcagcctctccggtcgcactggagatgtacggtataaacggagtccggattgatttctgagctaaaaagcgcttgtacggctgttccgcctgatcaaccagcgctgagtgaaacccgtaagataccggcaatagctgatgaggaatctgcttttctctcagatcgtccatgatctttttgatatgttcccgctctcccgagatgacaaagtgagaatgatagtttacagatgccaattcactatgttcgccgagcagcggatcatcttgatataaagccggatcacccagtatcgcaagcatgctgccgttacggcaagtttccgtaacgattcgggcctgttccagcacgcaatctaaagcatcctcggcgctcagcacgcccgacacagcggccgctgcatactctccgaggcttgctccgatcacataatcgggacgtatgcctctttgctccaaagcatatgcaagtgcgtactcagccataaaaatggcaggatggctgaaaagaaggcggtcaaatggatcagacagacgattgcctgtatgatacatctctttaaggacagagtaaccgaaacggctgactgcaaaatcgtccaagtcaagcattttctgccgaaaagcggcgttatgtgcaaacagctctttccccatttgatagtattgggaaccctgtccagaaaacatgaaaacaattggctggttcatttgttctcctttttgctctttattttttcaaaatattgatttgtgagtttttcgtgatgtcgtgtgcaggtgaagtggtcgtgatgttgtatggctggcactattgtgtgagataagaattttgacttgcgttccgctacatggcgggtgaagcttcagtttcttttttgatgcggtgaataagtcctgtcagcacatggcccggtccgacttcttcaaattccatccgccctttgtccagcagatagcggatgctgtcgttccatcgcactgaatggtcgatctgatcggccagaacggagtggattccgtcttgctcataaggtctggcatgcacattagaaatgacaggaattgatatagcagaaaaatgaaatgactgtaaaaatttttcgaactcttgttttgcttcactcatatacctcgagtgaaaagcgccgcttacgtttaacggatgaaacatcgtaacgtcttttaatccttcgaatacgcttttggctctttcaatgtcttctttgcgtccggatatgacaacttggtgaggagaattcatattggcaatatcaattgtatgtaatccgtgcgtttgaagggcgtctgacacttgagctgcagttaaccccataacagcggccatttttccgtcagtggccatactcattaattcgcctcttttacggacaagctgcaggccggtaataaaatcaaaagcacctgctgcaaacagcgcattatattctcccaaactgtggccggcaacataatccggctttatgtcattgtcttggatttttttcaaatagcttaacgcgtttacaacatataaagcaggctgggtgaactgcgtcttgtgaaggttggaatacggattctcaagacaaagccgtttcatggaatatccgagtgtttcatcagcctgctccgttaagtctttaaattcatcaaacaatgagctccccattccctgcttttgagaaccttgtccggggaataagtatgtgatcattttctcagccatcctttctcggattcagataagaagcatgttcaagttgatagtaacttcacaaaaataccatgtcaagttaatttatcctatgtgaactcctgaataatgcctatttttccctgtcgaaaggcggactcagggctttcggaacaggcgtaagcagaatgtcccatccggcctgcccggcgttctcttccgcaaactcccgttactcagccattcatcaccagaaatctagtaataacttccattccatttcagaagttccttgcctcaaaagaaaagctagttagatagaactaaattacacattacttaaaatgaaacagccctttttgattttttctgttgcggaaattcacaaaatgttcttttttttcaatctgaaagtaaatattgtttttcaaaagactctccattttttgacccggcttctccccgaaggagtgccccggatacacacgcacatgcggcggaatggaggctttgatcctctgtatactgtgaaacatatcttcagctgagctgcccctgtcctcacatataccgcacccttctgtaaacacggtgtcaccggtaaaaagatgatcagatagcaaatagcacattcccccggccgtatgtcccggggtcagtatacttctgatgataaaccctccggccgcaaaggtttggccgtcttcaagcgctattaagtttctgcaccggaattgatagaaatcgatttccgccgacgacatgtatatatcagaatgatagatttgctgaagcggctccgccaagtttacatggtcataatgcgaatgtgttaataaaatagcggataaatcaacatccaattcatgcagtttatcggttattttatcgatttcccaggacgggtccaccgctatcgcagatttttttgatcggtctgcgataatataacaatagttggaccacatctggtgataagttttgatttgatgcacttcatatgtatgatccattgtcaccattcccatttaaaagatccgggcagactgctgccgccgcccagccgactgtaaccactttaccagatgacaccacgtttttccatggattttccggtaaagttaaaaaaactttctgctcccgccaaaagcaccagtctggaccttttttacaatttgctatgctgatatataaggaaatcagaatattaatttagatgaattctttagggaattttattcagaaaatgaaggatgaatatgagtttcggataaaaagaaaacaaattgagcttttgttttgaaaagcaattgccgaagcggtcgaaggggataatcagtttttagaaatgatccgcaatcaagattattatttcaatccttttcttcaagataaactaaatcatacgggctctcgaaatatatcagaataccttagttcttacaccgaattcaacgttatgttgacattaacataattgaacttagaaaagtaaggcggaatttacactcttttcaaatcagccctagctgcaacaattcacgaaagcgtcgcgcagctttttactgtgcaaaaccaaaactaacataaaatcattaagtgtaaaaagtaaatattaatcattagacaaatagactgtgttatatgggtcggagtttactgctcaaggtaaattgccctgggatgcaaaagcactaagagcagattgggatgcaatacctgctaaagttaaagctgctatgggcggaatcggcgttttgaaataattcttaatacgatcgacaattttactggtgcagttgaagatgcgtgctatgcgggtgctctaaaagaactggcaacccaacagccgcttggcggattactaaaactcttaggcttttcatttaaacggggctattgttggtgtttaacaaatttatcctgtgttaagctttaaagtgattattttctaaagtgctaagatcggaggtaactatggaacataaaagtaatgctgaaccgagcccaaaagctataaaaattctaactttcatcattcctatagttttaataggacttatccttgttcttaagaatattaataccgcagcagcagaaatttcattttatatcgttgctatcggtgtggttctcttagtggttttcagtttgatcaaaaatagaaaaaaccgcaggaagaactaaatgtaagggggggctaattactagtcccccttgactaacttgcggatagtataacctgccaaattccaattttatttaaattccccctccatctcctccctgtgaatttggaaaagcaggtacccatctatataactcagggtagtcacctggttcttcacagataactttaagattttaaggaatcgttttctccattatttcactattaatgcagtgacatatagacggttacaccaaacacaagatgctgcgctgtcaccccaaatactatccataaacaatttttatatgaaagaaaagcagctggatgttaaacaaattattttcatgatttacggcatacagatgcaacaattataccagaaattaaaaaactcaaaagttatctctgacaggctgggtcattcaaactagtaaggctacttgtgggcaaataacggtttagtctcacataaatcattgttcttgcatcacacgcttaaacatcttctccatctcatacgtactgttatttttagttttttgacaataaaccatgattactcaaaacattgatatttcagagcttctaatagttttctgggtaaatatttttattaaattagcatggttagacataaagagagcagcctccttttttgatgataataaatatgatgatgagtggaccgagaatggttacaaaattaaatttaagcgaacccctattataaatatagcggatgtttatatatctaagaaatagtcttaactttttaatttaagggaatgaaagatatgctgactcagaaaggaaatataccgtattatacttaacatgagctaccgatgtaaaaggccagttaaagagaaaaacaggaaaaagcgaaatagatttacgtgcagttgtaaaaagtctcatgcgacaaggagaggttccgtaagacaaaatacaaaattgcatcatctaaaaaagcccaaactctaaaaagttgggcttttaatttaagcggggagaaagcgatttgtagccttaaaataaagtttgattaaatgaacttaataaaccttgataaaagtacaaatagaaaaaacgtgttttgaaaaaaagattgatcaaaacacgttttttctatattcatttcaatcatcgttttataaaaaagtttgatcattttatgtctagaatcttcaacaaacgcgcagtctgaggaatagtaccttataataaaaactgctgagtgctacctagactgaatactccacccatgtgttttaagcttttttatataatcttcaacactaattttttcaacttcaattgctaacggcgtcagtgaaacaaggcactcatttgaagtataatttattgtaacttttaccacctcgtatccattatggaaacctgaatcaaatccaggatcgtcaattatatctcctacttgagggcgaaagtcagattcaaatgttttcactaatgtttgagtattttcctctgtaggttcttgattaattgatgagacaaataatattaaatttatattcaaagcatttcccccctttctatgctgtttaaataatctttagtttaattctattgttattgatgataacaaattttaacttgcatcacaaattaattgtgccattaaatggaccgtttgttgaattctaaaaatctgtattgttaatgtgattctatcaaacttttttataaattatcggactttgttttacataatcaatctttattttaaagctacacgattaagttttttagtcctcccctgtttttcttttatttgattttactactatccccgtaatttgcacaaatggaaaaaccgcaatatgattgcggtctgctgtgaatctgtatttgaagttattcagtccgctcatcagcttgcggctttagtaagatggttaagacaattcctgataatatcaaaacatttctataaaaaaagattcggattatagaatgcttaaagacaattacctggacaaggaacaagtatctgtctttatggaggcagcaaaatcttctaaatatcatcacatgatcgctttaactcttttaaggaccggcttaagaaaaggtgaactcattgctttatattggtccgatattgactttaataacaaaactttaaggattgctaaatctaagaacgagtttggaatcatagcacctaaaacccgtaaaagtgttagaactataagcatcgatgacactttaattaaagagatgaaaaagtttaaggaatggcaagaagaaaataaaataaaacacggtgataattataaccagtctcccttttttattatcaaccataagggagatgaccttggaccgtttggaattgataaagtcatagattccttgctaaagaaaactgatctgcaccacattactccacatggtttgagacacacacacgccattatgctgctagaaagtggtgcagatatcaaatttgcaagtgagagactcggtcatacggatgtgaaaatgacagctgatgtctatatccatatcttgcagaatcacaatcaaaaaagcattaatcagtttgatgaatacctaaacagctaaaatcagtgggcaaaatgtgggcacgagagataaatccctcacagaatccttctacatcacacgcttaaacatcttctccatctcatacgtgctgtgatgaattatgatcggccggccgtgcgggcatgtgaacgggtctgtcgttcggcgcaggtcatccaagagcgctttgatttcgtcgtttcgcaaatggcggttcgctttgattgagcctttgcagctcatcataatggccgcttcctcccgcagttttttaatatcgatctgtttggcgtcaagcacctgctgaatgatttcttcaatcagttcagcttcttccccttttggaaaccaggccggatggcagcggacgatgtagctgttcgtgccgaatgcttctaaaaatactccgacgctttcaagctcatgctgatgctggtcaatgatcagcgcctcatttgccgcataatgaaaggtgagcggcacgatcatatcctgcacttcaggctcgacctgcccaactttctcccggaaatattcgtatttaatccgttcttgtgcagcatgctggtcaatgatatacaagccgttttcgttttgggctaaaatatatgtcccgtgcatttggccgatcggatacatcaccggaactctttcttcccgtatttcttcagagtcagcctcctcttcaggctccggaatatcggaaacatgcgcttccgttaccggcatgccgatcttcggcggcactccgtgacccgcttcatccggcagggactcttcttctattaccggctcaggctcttttacgaccgaactcagcttcatcggtgagtaagacggctccggcgttttttcaggaagtttccgctcaggcgcgctttcctcgaatgtcataaattgctgttcgtttttggccggtgccggcgcggattttttcgggagctgggcgctcggaataagccgctgcttttgaaacacttcctttatcccgtcacggatcagctcatgcagctccgtctctttgctgaggcggacttcaagcttcgagggatggacattgacatcgaccaaaatcgggtccatcgtaatttcgataaacgtaatcggatggcggccgatcggcagtagtgtgtgatagccctcatgcaccgcttttacaagcgggaaattcttaatgtatcttccgttaatgacagatgacatgtagtttctggatgcacgcgtgatttccggaagcgcaatgtagcccttgacttcaaaatcaagcgagctgacatggagcggtatcatttttttcgcaaccgccgtcccgtaaattgcggccagcacatggcgcacgtccccgttaccgtttgtctgcagcagatttttcccctgatggcggagacggatcgatacttccggatgcgcaagagcgatccggttgacaacatccgtaatattgccgagctccgtatgcacggttttcatatatttcaatctggcgggtgtattgaaaaacaggttggtaacgataatctccgttccttttctgctggaggatttctgctcagaaatgatattcccgccctgaagaatgagatgggttcccgctccctcgccgatgctcgttttgatttccagatgagaaacagacgcgatacttggcaaagcttctccgcggaaaccgagtgttctcacccggaacaggtcgttttcatctttgattttactggtcgcgtggcggcggaaagcccgcttgcaatcatcggtttccatcccttcgccgttatcgagcacccgaatcgacgaaagccccgcttcctctatgtcgatttcaatgactgtgctgtttgcgtcgatggcgttttccaccaattctttaacgactgaggcaggccgttcgaccacctcgccggccgctattttattcgagagttcatctgacagctggatgacttttgccaagtccgtcacctctttctattttaattttttttgcagcttgtacatttcattcatcgcctcaagcggcgtcatatcgagaatattgattgacttaaaagcttcaagcacttgtttttctttattagaaacagccggtgccttctgttctttttcaccgtcagcaaaaaaggacagctgtgccggttcttctctgacggcggactttttctcagataccgccggaagctccggtttatctcccgtctgctcaagctgtttcaaaatctcctgcgcgcggctgatcagatcgtccgggagctcggcaagctgggcgacatgaatgccgtaacttttatctgcggctccttctttgatttgatggagaaacacgaccgttccgttatattcctctgcgcgcacatgaacatttttcagctgaggaagcttatcttcaagcaccgtcagctcatgataatgcgtgctgaacagtgttttagcgccgatatgatcatggacatactcaataattgcctgtgccagcgccattccgtcgtacgttgatgtcccgcggccgatttcatcaaacaggatcaggctgtcttttgtggcgttcacaatcgcgtttttcgcttccagcatttccaccataaaggtgctttgtccggaaatcaaatcatccgctgccccgattctcgtgaagatttgatcaaaaatcggcagaaccgcttcttttgcgggcacaaaacagccgatctgagccatgatcgatagaagtgcgatctgtctcatatacgtgcttttacctgacatattcggacccgtaatcaggagcatttcccgcgaatcgcccatcaggcagttgttcgggacgtattcttgactgtccatcaccttttcaacgacggggtgtctcccttcaatgacttttacttcattatcagaaaagacgggctttgtgtaatgcctgttttcactgatcgtagcaaagcattgcagtgcgtccagctcactcatttgtttggcaagacgctgcagacgcggaataaattgtttcaccttttcacgcagtccggcaaaaagctcatattccagctcgcagatgttgttttccgcttctaaaataagcgcttctttttccttcaattccggcgtaatgtaccgttcggcgtttgtgagggtctgcttccgctcataccgtccgtcctcaagcagatgaaggtttgcttttgtgacttcaatataatagccgaacactttattgaaaccgacctttaatgaacggatgcccgtataagcgcgttcctgctgctccagtctggcaatccagtctttaccgtttttgctggcgtcacggtactcatcgagcttctgatgatagccgtctttaattaaattgccttcttttaacgataacggcgggttttcatgaagggcttcttctaacaggtcaagcaaatctccgcacggatcaatcaagccggcgcgttcttttgcttttttatggttaagagaccctacaagctctttgatgctcggcacttgttttaaagattctttcagctggattaaatcccttgcgttgacgtttccgaatgcgacccggcccgccagacgttctaaatcgtatacttccttcaggcgctctcgcagatcttcacgctcaaacagatgattgatcagcgtctcgaccatttcctggcgttcttcgatttgggatgccctgatcagcgggcggtcaatccattgtttgagaagccggccgcccatcgctgttttcgtctcgtctaaaagccaaagcaatgacccttttttgcttttagaacggatcgtttccgtcagctcaagattccgttttgaatacaggtcaattttcatcgcttcttccaattcatatacttgaaccggctgcaggtgatccaggctccgtttttgcgttttctgcaaatacgtatataaacgcataaacgtctctgtcagctcttcgcccggcaagtgctttgcgatttcaatgcgttctgttatttccccgtcttcgatggaaatcgtggcgccgcaccgttctttcagctgagcagctgtatgttcgttaaacttgctcgatacgacaatttcctttgcgccgactgagtaaatttctgacatgacatcttcaatccgctcaataaatacggccaggttttctccggtcgttaagtccgataaagcgagaccgtatccgtcacgaaattcggaaacggaagcgataaagttgttttccgactcgtggatgccttttccatccatcacggttcccggtgtgatcagctggacgacttctctttttacaacgcctttagccgccttcggatcttccgtctgttcacagatcgccactttatagccctttttaatcagctgttcaatataagccgccgcggaatgataaggcacgccgcacatcggaattttatcagccgaacctccgtctctgcttgtcagtgtaatttcaagctcttgtgacgctttttttgcatcttcaaaaaacatttcataaaagtcaccaagccgaaaaaataaaaaggcatcttggtgctctgcctttatcttcaagtattgctgtatcataggcgtgtaactagccatcatttaatccctcactatgtatcttctcttatccgaatcccattataacataaacaaaagagtgatatctttatatataaaaaagagacttggggtgttaaactcccctagcctcaacttattcttcaggatctccgactaaaaattcagggttaatgtcctctaattcttcatcaagatcgtcttcccaatcatcatcatcgtcttcttcccagtcaggattgacttcgacgacgactttcgtttcaccgaccacttctgctaaaaattctctctctgcctgaaccacgattttatttccgttaggagaaatggtgacttcaagacaattcggctgctgcagcactttggcaatgacttcgtgttcgtcatctaagtaatttgtgtctctgtatctgagtttaatcacatcgacatactttactctctcggttacaacttccgtttttgtattatcggcgtaagagtaccagacgtttatatcataatacccttcaatttctacagtcttcccgatcttttcggcatcgtacttgtggttgataatccagccgcccaatatacttgacggtttttctccaggtgagatcgtgttggtgcattgggtgaattttcttcctttcgcaactaccgctttcgtaataatttccctgtattcagacattccggcaggcctccttgttcttcttcgtgttatcttatgctgggcatttgtctcatgtgcatttttataataaaaatataaaaatacaaagtttctgtttcattgtatgcagccctgcccagaaactttacttttaagtatgataaaactttccagtaaaatgggacaaaacggtgagtcaatgaaaatttagtacatattacaattagttctcaaacagcaaaaaaacacgggccgatgaaggccccgtgtttaaatagaacagctgttattcgaatgttttacttttgaaccggtttctcccgtcagcaggttgcctccggtagatgtaatgatttcgtttgtcacctgatttgagatcgtatgtgcgacaagctgaagaaggtcattgacctcaatctgggaatctctgaattcttgaatgatcggaatcccttcaagttcttcctgcagggcgtcaattttactttccacttgtttcagcgcttcaagcttttcgtagtgcttcaggttaacggcttgcttttgcagagttttaatctgattaataatcgcggagactttttcattttcgttaatctgcgcctcggcgcgtttgaaaaaatcaacttcttctgtttcagaaatcattttcgcaaggttcctagcctgctgtacaatgtctttctttgagtaaagcgtcattattatttcacctcgattgcttctcctgccatcacaccgtcaagcgaccatgttttcgcctgttcgattttgacgcgtacaatcttgccgatggcgtctttcggccctttgaagttgacgagcttgcttttttccgtatagccggcaagaatgtcagggttatttttgctttctccctcaactaatacttcgacagtcctgccttcatattccttcatttttttggctgaaatttctttcaccaaatcattgaggcgctgaagacgttctttcttgaccctcatcggaacattgtctttcatcttcgctgccggcgtgccttcacgaggagagtaaataaacgtatatgcgctgtcaaattccacttcgcgatataacgaaagcgtttcttcaaattgttcatcggtttcattcggaaaaccgacaataatatcggtcgtcagtgaagcgttcggcatcgccgctttaatttttccgacaagctccagatagcgttctctgtcatatttgcgcgccatcatttttaacatcgctgagcttcctgattgaaccggaagatggatatggtcaagaaggttgccgcctttggcgagcacttcgatcagatgatcatcaaagtcacgcggatgactcgtcgtgaatcggattctcggaatatcaattttacgcagttcgtccattaaatcaccgagtccgtacgtcatatcctcaaaatcttttccgtacgcattcacgttttgaccgagcagtgtgatttctttatagccttcgcttgcaagtcttctgacttcctggataatttcctcaggacggcggcttcgttcttttccgcgggtatacggtacgatgcagtatgtgcagaacttgtcacagccgtacataatgttgacccagcctttaatttttccgttgcggactttcggaaggttttcaatgacatccccttccttcgaccacacttcaatgaccatctcttttgataaatatgcctctgataacagttccggcagacggtgaatgttgtgcgtgccgaaaatcatatcgacaaacgggtgcttcttaaggatgcggtttacgactgattcttcctgtgacatgcagccgcagacgccgagaatcaagtccgggttattttttttgagcgcctttaaatggccgagctcgccgaacactttgttttcagcattttcccggatagcgcaagtgtttaataaaataacgttcgcgtcatcaaccgaatttgtcgcttcataaccgagcgccataaaaatacccgccatgacttccgtatcatgctcgttcatttggcatccgtacgtgcggatataaaatttcctgccttcaccgaggcctttaaattcttctgagattttaaaatcgttatgatattgaacggattctttgccccgttttttcgcatcttttaaagaaggcggaatatatacggcttcaaaatacttgctgtaatccttttcggattttttgtccgccggattcacttgtccgctttcctgcttttgcttttcattcatgttcgaatgtctcctttcaaccgaaacttccaccctcaagtatactggttaaaagcgtttgacacaaccgccagcctattattgtacaccttattgagaataagaatcaataagaaataaaaaagagggaatcatttcccccttacacaagctgcagctcttttgcggctgaacggattacttccagggcccggtcaagctcctcttttgtatgctccgccgtaataatggtgcggattctcgcttttccttgggcgaccgtcggatacacgatgctttgtgcaaagacgccgcgggtcaataaaaggtctgataatgcctgggctttttcttcctcccctattaatatcggcacgatcggtgtttcgctttttgtgagggtcagccccatttgaaccagtttgtctttgaaatacgccgtgttctcccatagcttttccatatgctccggctcttccagcaggacgtcaatggcttctatgcatgcggccgttaccgcaggcggatgagaagtgctgaataagaaaggacgccctttatggcgcaggtaatcgatcagaacctgcgaccctgcggcataaccgccaagcactccgatggctttgcttaatgtgcccacctgtatgtggactcttccgtcaagcccgaagtgattaaccgttccccttccgttttttccgagtacgccggaagcatgcgcgtcgtcgaccatcacaaaggcatcgtacgcctctgcaagtttgacgatgtcaggcaaaggagcgatgttgccgtccattgagaatacgccgtcggtgacgatcaggcgcatgcggtaattcattgattttttcagcaccctttccaaatcgtccatatcaacatggcggtacacctttttatctgctttcgtcagcctgatcccgtcaatgatggaagcatggttcagttcgtcagagatcacgatatcttcttttgtaagaatgcttgataagacgccctgattcgttgtgaaccccgattgaaaaacaagtgccgcttctgtttttttaaagtttgccaattttttctccagctcattgtgcattgtgaatgttccggcgattgtccggacggaccccgtacccgctccgaattcttccgcggcgcgtttggccgcttcgacaagccttggatgcgacgtcaaaccgagataattgttcgatgaaagctgtatcacgttttcccctttgacttgcaccgacggaccctgcttcgtttcaatttgtttcatttgctgccacgttttattttctttcattttatcaagctctgcttttagaaattcaaattctttcattatagaaccctccccttatggaatcaaaatgactttgccgcactggccctttctcatcaggtcaaaccctttttcaaagtcttcaagcggaaactgatgcgtgatcaccggcgtcagatcaacaaggccggattcaagcaggtgcgatacctgccgccatgtttcaaacatttttctgcctgtgatgccttggacggtaagtcctttaaacaccacgtcatttgtcaggtcaaccgtcaccggacgttccggcagactcagcatgtggaaccttcccccgttggccgccatctttaatccttgtgctatagctgccgggtggcctgacatttcgcagacaaggtcgatcccttctccgcctgttaaggtgtcgatcacctcaagcggatcttccttatcagctgaaatggtgatcgtggctcccaatttcttcgcaagagccagcctgtaatcatttttatcaatggccgcaatacaggatgcaccggccgctttagccactgccaccgccatcagcccgatcggtccgcagccgataattgcagcggaaccgcccgcaagctggctgctttccagcaccgtatgcaccgcgttgccaagcggctcttgaacagaagcgacggcggggtccatatcagcgggatttttccaaacatttcgagccggcactttgacatattcagcgaaggaaccggctgtatctacgccgaggatctttgtatgggtgcacacatgatgttttcctgttaaacaagggacacaagtaccgcagacgaagtgggtttcagccgaaacgtagtcacctattttgacatttgtgacgtgcttgcccgtttccgctacgataccgctgaattcatgtccgaatacttgaggtgttttgattcgtttctgagcccattgatcccaattataaatatgcacatctgtaccgcatatagatgcggcctgtactttaatgagaacttcattctcattaatggaaggtatgggaatttctttcagagttgctccgaaagcgttttcatttttgacgatagctttcatctttcctcccaacatgtacactcctcctcgaaaaaacactgtaataactggattgtaacatgagataaaaaggaggtaaataccagtgtccactccatgaaaacaactgcttccgtccggaaaaatgggcgggattttttttgaatattatatgaataaagccatttatcatctcttcgtactattaatataatattgtgagaaaatatgacaacaataaaaacaacccgctcgccttacgcaagcaggttgagaatatcatgtttttgtttttaacggggttcgacgattaacttaatcgccgttctttcttctccgtcaatctgtatatctgtaaaagccggaatacaaatcaaatctacgccgcttggcgcgacaaagcctctggcaatcgcaaccgctttaacagcctggtttaaggcacccgccccaattgcttgaatttcggcggctccgcgttccctcaatacaccggcaagcgcgcctgctactgaatttggacttgattttgctgaaacttttaagatttccatttctgctcccccttagttttacaatggataagtgagtgttcattagaacaatcattattagatgttgctatccaaaaagccatccccacaatgcttttcaaaaatagcgggctaccttccatttctactatattcactaagaagttgctatattcctgcttttccttttaatatttttataaaataaacacatgatcacctattcaaagaacatatggtcatcattgattaatatccgttcgatatttacggcctttttcgtttgatcgtcgatgtcaatgagcactccgctcagtgtagttttaccttccgccaccgtaaaccggacgggaagattggttttaaaccgcttgatgaccgtttctctgtccataccgagaattccgtcgtacggacccgtcatgcctacatcagtaatatatgccgttcctttcggcaaaatgcggttatctgccgtttgcacgtgtgtatgggtgcctaccacggcagaggctcttccgtctgtgtaccagccgatcgcaattttttcgcttgtcgcttcggcgtgaaaatcaataaaaatgtacggcgtgcgctttttcgcttcttctattaattcatccgctttagcaaacggatcatcaagcggcggaagaaacgtccgcccctgtaaattaatgacggcaagctcttttccgttcgatttaatataagtaatgcctttgcccggcgtaccttccgggaaattcgccggccggacaagatgcggcacatcatcaataaagtcgaagatctctcttttatcccacgtatggtttcccattgtaatggcatctgctcccgcttccatcaggctgtggtagatcttttctgtcagtccttttccatgtgctgcattttctccgttaataattgtaaaatgcggtttatgtttcgctttcagtttcgggacatattcttttaccatgtcgcggcccggggaaccgacaacatctccgataaataaaattctcatacattccattccttccttttcagggactcaaaaaaataaagtgatgcgctaagcatcactttattttgcatactctacggctcgagtttctctgattacggtcactttaatgtggcccggataatcaagctcgtcctcaattcgtttacggatatcacgtgccaaacgatgggcttctaaatcattaatggagtccggcttcaccatgatgcgaacttcacggccggcctgaatcgcaaatgatttttcaacaccttcgtaagactcggagatttcttcaagcttttcaagtctgcggatatagttttcgagcgtttcacttctcgcacccggtcttgcggctgacagtgcatcagcggcagcaaccagaacggcgataatggaagtcggctcttcgtctccgtggtgtgacgcaatactgttaatgacgactggatgctctttatatttggtcgcaagctccactccgatttccacgtggcttccttccacttcatggtcaattgcttttccgatgtcatgcagaagaccggcccgcttggcaagctttgcatcttctccaagctcggaagccattaaacctgctaaaaacgcaacttccatagaatgtttcagtacgttctgcccgtagcttgtacggaatttcaaccggccgaggatcttgatcagatccgggtggaggccgtgaacgccgacttcaaacgtcgtctgctcacccatttcccggatatagtcatctacctcacggcgggatttttcaaccatttcttcaatgcgcgccgggtgaatacggccatcctgaacgagtttatcaagagcgattcttgccgtctcccgtctgatcggatcaaatccggaaagaatgactgcttcaggtgtgtcatcaataatcaggtcaatacctgtaagcgtttcaagcgtacgaatgttacgcccttcacggccgatgatacgtcctttcatctcatcattcggaagattgacgaccgataccgtcgtttcggcaacatgatctgctgcacagcgctgcaaagcaagcgacagaatgtttttcgcctttttatctgcctcttctttcgcacggttttcggtttcttttgtcatgatggcgatgtcatgtgaaagctcattttcaacccggtcaagaatgatttgtttcgcttcatcccgtgtcaggctcgaaatgcgttcgagttctgactgctgcatacgaatcatctcatccactttgctttccatctcttcaatatgttgttgtcgttcattcagagaatgatctttcttctccaacatcgcttcccgtttatcaattccttcatgtttacggtcaagattttcttctttttgaagtaaacggttttcttgtttttgaagctcatttcgtctttcacgaacttcctgttcagcatctattcgaagtgtatggatttcgtcctttgcttcaagcagagcttcttttttcagtgcttcagcatcacgctttgcatcttcaaggatttgctcggcagcaccgcgtgcgcccgcaatctttgcttcggcaatggttttacgaacatagtagccaacaactaaaccgagcagagtcagcaaaatggagatgagaaccgtcattggggtcatactttcacctcctcttgctatgaacttggtttttgcttaaataagtgccggcatgtacattgtctgattttctcaacatacagaaccttcacagggaatgagtctctcacgcccttgtcaagtttaaatggtttaacaatcatgttaaaaaaacaaatgttacaacttcattgtaattgtgtcggaaatacttgtcaagcttgccagcttaacgattcgccttcagctcggatcttcgcccatgtatatatcataccatacctagatccgcttttcgtgaatgacggctctgttagtccggctggttaagcaattggtaaattctattgtttacctgtcctaatttggcgttattctgaatgtttgacagtaatatgacatatttgcttgccgaatggctgaagctgttcaaaatgttgtaaccgggcataacaccgtgattggaatagcttcccggatcaatgtaaaaccccatgccgtaagcggcactgcttcctgctgtaaacatttttgtgaagctttcttttgaaaggagcgtgccgtttacgatcgctttatcaaatttatagagatcttcagcgctcatatacatgtcgcccgccccgtacagctgcgataagtccaaaaggtgcggcgttacaagactgccgctctcatcgactttgtagccgacggcaggatatttggctttggcaaatgttttgtaaaatccggcatgcttcattccggccggtttgaacacgtgttcttttatatattgttcataagactccccgctgacttgagatacgatataagcaagcactgaatagttggaatccctgtaatcccaaaccccgggctgccgtttaattccgcggtattctatatccttgattaaatcaattggagaaatcggtccctgtccctcaatatgcccgtttatgccggacgtatgattgagcaggtttttcaatgtaatgcgcgtgccgttaggaaaattcggcaagtatgtactgacggggtcactcgtctgcagcagccctttttcttcaagctgcaggacagccgtcgcgattaacgctttttgtgaagaaccgatataatatgatgtctccggattgtttttaattttttgttttcggtccgcatagccaaagccttttttcagcacaacttttccatcttttacgatcattgctgtgccgctgaacccgatctgttgcaagtaattgctgatctgtttattgtgatcgattgatttaggtgttttctctttttgcgtcttttcttttttctgttgagtctggtcttttgaagtatcagattgagcggcgggagcgtttttaacggattccttctcccggtgatgcgctgtgacggtccagatcataataaaaacagtgacaagcagcagaaaaagaaacagccctcccgttttcatcagcttcttctttctttttttatttattcttgtgcggcgggggctcgtcatcttttttcctcctcagatataatttcaactttcgccatgatgttagacgagtaaagggtgaaaaaagttgtaacattccagataaaattttccgaaacagccagtgtttttttgaaacacacaaaaaaagagcggaaattgcttattccgctcttttgatcgtgtttttattcttctaattccatctcttcctgaacttcttccgctttgtccgttacaccgttattgtctaaaccgtaatattcacggatttgttcctgaatcatcagcatgatgtctttattttcttttaagaactgcttggcgttttcacggccctgaccgagacgttcttcttcataagaataccacgaaccgcttttttgcacgatatccagttcagttccaaggtcgatgatttccccttctttggagattccttcaccgtacataatgtccacttcagccgtacggaacggaggagcgactttgttttttacgactttaattctcgttttattccccatcacgtcgttgccctgctttaattgctcggcacggcgcacttcaaggcgcacggaagaatagaatttcagcgcacggccgcccggtgtcgtctccggatttccgaacataacgccgactttttcacgaatctggttaataaagattgcgattgttttagatttattgatggcgccggaaagctttcggagcgcctgagacatgagacgcgcctgtaaaccgacgtgtgaatcacccatgtcaccttcaatttcagcttttggaacaagcgccgcaacagagtcaacgactacgatatcaacagctccgcttcgcaccagcgcttcagcaatctctagcgcctgctctcccgtatccggctgagaaagcagaagctcttcgatattgacaccgagcttttgcgcgtaaacaggatcaagagcatgctcagcatcaataaatgctgcctgtccgcctttttcctgaacctcagcgattgcgtgaagcgctacagtcgttttacctgagctttcaggtccgtatacttcaataatccgtccgcgcgggtatccgcctattccgagagcggtatcaagtgcaagggaaccgcttggcaccgttgaaattcttgtatccgttttttctccgagcttcatgatggaacctttgccgaattgtttttctatttgcttaagagccatatctaaggctgcctgacgatcactcatttattttttcctcctttatcttgccactacatatactataccttgtttactggcatttgccaagaaaaaagcgaacgcatattcggattttttccgcgttcgcttttctgcaaaagagcataatttcccttataaaacttaaaaatcagagaaaacggctctttaaaactttatttttgatccagcatttttaaaatgagatggcagccgtatttagcggcgcgctttctgatcccggttcttgagccggcaaagttaaattcgtgcacctcttcttttccttccgctgaaatgccgataaagacgcggcccggcgcatgcccttcctgcgggtcgggacccgcaaccccggtaaagctgatgccgatatcgcttccggtcagctttctcacaccggctgcaagctctttcgcacactctttgctgaccgctccgctttctgcgagcgtctcagctttcacgccgagcacatgctgtttcacgctgtcggaatagcagacaacgccccctgcaaatagttgagacgcaccgcttaaatcagtcacccactctgaaaacaggccgcctgtaaagctttcggcagaagaaatcgtaattccgttttgtctgcatgcttttgaaagctccttcaccagagacgtatcatcatatccgtagaaaaattcaccgacacgttctaaaatggcggcttccgtttcttttaaaagccgttctgtttctttttcgtcggcatgtttcgccgttaaacgcagcgtgacctctccgtcagcagcgagcggggcaatcgtcgggttcgtctgcgcatcaatgatatcttctaaatcagcttcaagctgggattcaccgattccgaaaaaccgcagcacggttgaaacgattttctcattagaaccgagctttttaagaagcagcggcttcgcttcattttcaaacatcggacgcagctcgctcggcggcccgggaagcagcatataaagccttgagccgtgctctgcaagcattcccggcgccatgccgaaatgattcgccaaaacgtctgagccctcaatgacgagcgcctgtttgcggttattcggcgacatggtccgttttgttttcgcgaaatattcttcgatcgaccggaacgcttcgtcattcagaacgagcgggcgccccagtgtgtttgcaatggtttctttcgtcaaatcgtccttggtcggtccgaggccgcctgaaaaaataatcaggtctgagcgctcttcggcaatgcggatgacttgcttaagccgctccggattgtcaccgacagcggtatgataaaacacgtttacaccgatttccgccagctctttactgataaactgcgcgttcgtattggcgatctggccgagcagaagctccgagccgactgcaatgatttctgctttttttgctatttccatctttaagtccttctttcttagttagatgtttttaacgcatcccagttcttcgcaaaataatcccagccggaaatgactgtgaagagcacggccacccataaagcgatatcgccgaacgggaaagaaacgagctcaaacggaagattatgcagcaaaagcgcggcaacagcgatgatctgagcccatgttttaattttccccagcatattggcggctacaacttcccccgttcccgccagcacaagtcttaatcccgttacggcaaattcgcggctgatgatgatgatgaccatccacgccggcgcaaggtcaaactgcacaagcgtaattaatgccgcggacaccagcagtttgtcagccagcggatctaaaaatttcccgaaatttgtcacgaggttcagttttctggcgtagtagccatccacccagtcagtcgttgatgcgataatgaacaaaacagctcccgtaagatgcgcgaccggaatcgattcatcccctatatgaacgctgccccactgaaaaggaacaagcatgataatcataaatacaggaattaaagcgattcttgccagtgtgattttattcggtaagttaaacataaagcccctccaatatatgtactcggacgtgaagaaaaagtcatcttaatcgttcagatgacttttccccttttattttttcatcttgattgtgatggtctgcgccatcacatcatgcggattgagttcataggacagaacctctccgttgattttaattttcaggttaggggcatagcccgtgcggatttcaatctgcttttgatccgtgacgtcttttttaaaggtttcgcctttttgcagcgttccttcttttaaagaaccgccgctgtcatcacggacgcggatccatgcgctgtcagaagcaatcagttcaagcttatacttatctgccccggagacgttgtatgaagaagccgagccttccgttccggccgctttgatctccgtcttttcactgcttttttctttcttctgctctgacgcttttgtgtcctttttgtcttttttgctgtcagattgcgcttcgtcatttgtattgccgtcgtttttcagcgcagaatccttaggaatctcatacttgctctcactttgggtgactgccttatctccatctgtctgcccggatttgctcattccgagctgaataatcgcataaatgatcgcgatgacgataatgacaccgatgacgacaaggacggtcggaagccattccgccgcctttgaagcggacttaggaagctccctttgcatggcgagaccggagattttttccgacacatcgtcatggtacgtgttagggatgtcttttttatattcttcaaataactgatctgaatcaagcccgacagcttcagcgtattgcttgataaacgcccgcacataaaaattgccgggaatgacgtcataattgccttcttccagagcggttaagtatcttttctgaattttcgtcgccgcctggagttcatccaatgacatccctttttcctctctggcttctttaagccggattgctaattctgtcacaacaaacaccttccaatattaaaagtcaaagcttgaaaaaccggtctgatcaaatatttgcggttcttctgcatgttcatatgtaataacttcgtcaggatcatttctgagttcgataatataatcgaaatcatcgagcgtatactccgaattttgaacaaaaatatcggggtgctccacgacctttgtcgccggaagccgcataatttcactgacgagctgaagatggcgctcagatccccgtcttgtcgaaacgatgccgtcgaggataaacacgttttccgtgctgtattcatcggcaaccagctggctccggatcgtttgttttagcagcgttgatgatacgaaaagccatcttttgctggcacaaacgcttgacgcaacgatggactccgtttttccgaccctcggcattccccggattccgatcagtttgtgtccttcttttttaaacagctcggccataaagtcaaccagaagaccgagctcgtccctttcaaaacggaaggtttttttgtcatcggcatcacgctgaatgtatcttccgtggcggactgcgagacggtcgcgaagcctcggttctctcagcttcgttactttaatggtctccattgtttttaaaattgattccaatcgtttaatttgatctatatgccggcatctgagcagcattccccttctggaaaggtcgacaccgttaattgtgacaatattaattgacagcatcccgagaagagatgaaatatccccgagcaggccggggcggttcacttgaatttcatattcaaaataccattcgagctttgccaaatgatataccccctccattgtggcaaatttttaccttcctttatcataaaacatttttctctaattagaaagaagaatgttgctctatagaggaaaacataaaaaaagagaggagaaatcccccctcttaatgagtgctgttattttcaacaagcttcaccatcatatttgcgatggcgcgctgttcatcttcagaagcaacgctccaaagatcagcaagcactttttcctgatggtttttcgagtcgacttcgttcgcaaggtaaccgccgatttctgtagcgaggtcagtgatcgtttcatcactcatccctttttcctgcgcatagttcaatctgtcgccaaggaaattcttccaattatcccagttttctaatactgacatgttgggttcctccatttcatctgttgttacaaaattattttgtccgtacagatgcaaactatacacacatttttttcagcagtgccagccgccgtttacggataatatatgccccgtaatataggaagccttgtccgataataaaaaggccgccgcttcggcgatttcctccggctttgccagccggcccgcgggaatttcctctgccaacgcttctttttcatcagacgtgaactgatcaagcatatttgtatcaacggcacccggcgagactgcattcacgcggacgccgctcggagcaagctctttggcaagcgctttgacgaacgaatgctgcgctcccttgaccatgctgtataatacctcgcacgatgcgcctgtttctccccagacggaaccgatcgcgacgatgcccccgctttttttccggatcatgccgggcatcagattacgcgccaaaagaaacggactcgttacatgcagctgcaccatctcccgcgccgtgtcatccgtaacgtccgtaatcaggccgaaatgacttttgccgctgtttaataccagagcatccacaggctgcttaacggaacggctgagtgtctccgcgccatccggtgaggacaaatccgcctgaataacggaggcttttacgccgaatgatgcgctcagcctttccgcaagcctgtgtgcggcttccttattagaatgataatgcaagaggacgtcatatccgttttttgcgaggacttcacttatactttgtccgattccgccgcttgctccggttacgagcgctgtctgtttcatcaatcaatactccttctttccccagaaaaacatccctcagggcgtgagggatgtttttgttatgattttggcacgactttgcagactgtcagcctgtcttctgatatttcttcttcaatgacccgctttacgtcatccagcgtaatctgctccagtacggttacgacatcaaacagactcatatctaaaaaggcgtagcgtgtgaattggttggcgatatattcaggcgaattgagcgcttttaagaatgacccgatcttcttttttctcgcaagatcaagtttttccgcagtcacggctgattccgcatcaagcagcatgtgttttaattcgtcagcgagcttatccggctccggtgtatctcctccgacagaggcaaaaccgaatccgtattcagccgtgtaatcgaagctgaaggtctcatcaatgtagcctttgtcgtacaagtcaccgtaatgcggtgagctttttccgaagagacattcaagcatgaggttcatgctgagctcgtgctttaacagcccccgccccgttttataagggtctttcgcctttaaaccgacaagacattttgagccttgcacgttcatttttaattcctgctcccggcggaaaaccgcttcctgctcctgaacttcttcacgtttgatttcgggctggtctgtaaacggctttttctcctggtttttccgcacctggctgatgaccgcttcaggatctacgggaccgacgataaagagcagcatattgctcgggtgataaaacgtttcgtagcactcatacagcagatctttcgtaatacgagagatgctctccaccgttccggcaatgtcaattttcacggggtggtctttatacatattttcgataaggccgaaaaacagccgccaatccggattatcatcatacatattgatttcctggccgatgatgcctttttctttttcaactgatttttccgtaaaatacgggtcctgaacaaagtctacgagtgtttccaggtttttctccacattagaagtactggagaacagataagcggttcgtgtaaatgatgtaaaggcatttgccgacgccccctgcttactaaagtcctgaaacacgtcgccgtccgctttttcaaacagtttatgctccagaaaatgcgcgattccgtcagggacgtgtaccatttcttccttatttaaaggaacgaattgattgtcaatggaaccgtactttgtcgtaaacacggcgtatgttttattaaagccctgtttcggcagcacatagacatcaaggccgtttgccattttttcatgatacagcgtttcctgaagctgttcgaagtttatcggtttagtcaagatgctccccccgtcccttttaagaaataagtcgtatccagcttaatgttctttccgacattgataatgtcctcttttgtcactttctcgatattgtcaaggaatctttcgatcggtatctctacttgggctgaggcctgctgatacagaaattccgctaagccgtatgccgtatcaatggtttctaatacttgatttttaataacggctttcgtttgggcgatatcatcttctgaaaagtcaccgttttgcatagcctgaaactgttcttcaatgatggtgacggcctgcttgtaatttttcacctcaatgcccgacatgaccatcaaaagccctttgaaactttccacccttgaggctgcataataggcgaggctagctttttcacggacatttataaacagctttgaatgagagaaacccccgaacagcccgttaaacacctgcaatgccggataatccggatctgtatatgtcgtattggtccggaatccgatattcagcttgccctgcttgacgtcctcttcatcaatgacttccttcggatcgggctgttcattcgccgcgcttctttcaaaaggctgcagctcccgttcttccgttttaaaatacgtatcaacggccgttttcacctgatctgtatcaacatcgccgatgacgtacaggtccagctgatcttcgcgtatggctttttgataggcttcatacaaatcttgcggtgtaatgtgttcaacatcatcgaactcgccgttgacgtgaagggcatacggttcgcttttgcacatttcctgaacgagacgcagattagaatatctcatcttatcatcatatacggcttgaatccgctgtttcagcgtccgtttttcctgcgtgacataaaggggcaggaaggcgccgttttccaaagcgggcgaaaagacaagctctgataaaagctgaaggcctttttccaataacggtgtgcggtccttcagatacttttcattaggaatctcaagcctgaacgtaatgacatgacgttctcccttttttgtcagatcagctgaaacggatgtgccgtacagctcatcaaaataagaccgcagatcagcggttttcgggcggctttctgttccgcgcagaagcacatgcggaaacagcgctctttttgttacgagctctttcgttaaaggagccagcattttaaacgtcagcgaaacggttttaaatttctcggtctttacgatgtgggcggtgatcccgccgtgctttgacttcatttcatttacgtaagtcatgtgaaacctccttcgttcattctttcatagtatgtattatgaccaaatttcagcattcgcaaaaaagagtgcgcagatgtaattatatcaactggaggatttataaggaaacaaaaaaacctctgcccgaaaacaggcagaggcattgagcgttattttttcaaattgaaaggccaccagttggctcttccgaatattttcaccatgaccggtacaaaaaacggaaggacgacaattgcgtacatgagaaggcctgttaataccacggttgcaatctgtaataaggaaagaacgcctgacggcagcatggccgcaaaggttcccgctaaaataatggctgcagaaatgatgacggaacccatatttttcatactgctgatcattgcgggttccgttccttcttttttaagctcattaaagcggtccattaaaaagatggaataatccacgcctagagccatcaaaatgacaaagccgaagaacggcacggcccagtttacgcccggatacccgaagaagtgtgtaaagatgtattccgtcacgccgatggatgcgaaatacgtcagtacgagcgacgccactaaataaacaggcataatgagggagcgcagcatcacgatgagaatcagaaaaattcccgccagcataaacatggccgtccgtttgaagtctgaagccgatacttccttcagatcggcattcatgctggagactcccgaaacgccgaaggaagcattcttcagatccgtgttcggaatggccctttttacgctcgctttgatcgcttgaatatcttgaatggccgtatttgagtaaggattgtgatcaagaacgacggtcaattctgtcgtttttctgtcatctgacatgtacgtattaaacacgcttgtgaaatcactgtttgtcaacgcgtctttcggcacaaaccagcctgtcatttctttgtctgacgccttgtgaagctcacccaggtaatcattcgcccccatcatgccgcttgatactttcttaagcccttttacactgtcgttaaggccggaagaaagttcgctgagccgggaagaaaaatcaccaagaccgctcttcatttttttctggccctcggcgagctgtcctgccgccgattcaaggcgcggcatttgtcccgcgagagccccctgtccgtctgacacttgctgcagaccgttttcaatactggtcagaccattgatcattgcgttaatttgagtgtcaatcttcttctgagcggctgccagtcgggcaaattgtttttccgcttgctgcagatgagccttttgactgtcgacctgtttagaaaaagcttctgcatccgcgtttgccttggaaacggctgactgtacacccgtaaaggccgatttgatttcttggtaagagggatcggttttgactgacggtattgacgcttccaattttgcaaacggcagccgggcaagctgcttgttcaaatcggcaagctgtctgctggcttcatctttcatcggcaggacggtttttaccaattttaaagcgttttgcgtttctgaagcgagaccgctgttttgtttgagctgtgaagtcagcatttgtttttgctcttcaatccgctttctcatctgggcgacgccggctttattctcgttcacgccagcctgcagtttattcaggttttctcctatatcagaaagcccggatttcagagacaatgttccgtcaataagctgattgacgcttttgcccgactcttcgatctgcggctgtgaatcagctaacgactttgcggcatgccctaatccgtccgtgattttttcaagtcctgtattgcctttatcaagcccttcttgaagctgctttgcctgatttgtgacaaataattgattcaatccgtttccagcggggcgcgtggcgcttctgaccgtttttacaccctctgttttttcaagttctctgctgattttttcgatatcaatcaggtgtttttcggtatttaatgtctcatcatttttgatgacgactgtggccggaagaagttctcccgggccgaatgcgtctgaaatcgtattaaacgcgcggacggattcatatttatccccgatttcgtcaagactgttgtaagacagcgaccctttgtaaagaaggataggcgggacggtgaataccgcaacgattgcaagactgatgagcggccttttaaatgaaaaccgccctgacgtttcccatgctttgctttgaggatgggaaatatcgcccttaacaggccaaaacaggctttttcctaaaacagccataaaaaacggcacgatcgtcatgagcgcaagcagcagcaccgcgacaccgaccgcaacggccgctgccgactgatacagcttaaatgtcgcaaatccgatgcaggcaaatccgatcagcaccgcaccgccgctgtacaaaaccgtctttccggccgttttgtaggtgacgacgatcgcttctcttatatcagcgccatgcgacagttcttctttaaatctgctgagaagcagaatgcagtagtctgtgccgatcccgaacataatcgcaaccataaaaatctgcgtaaaagttgagagcggaaaattcagctgatcgactaaaaatgcgacaatcgactggctgactaaataagatatcaatactgataaaagcggcacaaacggagcgaccactgaccgaaatacaaggatcagcacgatcaggataaaagcgaccgttatatattcagtctttttcaagccgtcctgtgagctttttaacacatcttcgtcgatcagcgattggcctgtaatgccgtatgatacgccgtacggtttcagctctttatcaattttattttttatttcgatgatatcgtttttggatgtatcaagctgcagctgaacgagcatcgtttttctgtcttttgagagcagctgttttttaatgtcgtcatttttctccccgaagtatgaagtcaccgttttaatctgaagcgcttttttatgttcagacaaagtgctgatggcttcttccagacgattttttttgtctgtcattaagcctttttcatgaaatacgatgacggcagaagaagacggtgcatcggaatcagacatttcatcaagcaattcatgggcgtaagaagaggaatatccgtccggtacggaaatctgccctttctcccgtgtcaattcagccatatcaggcgctgtaagcataaatatcaccgttgcggcgacccacaccgcggcgatgatccagcgggctcggataatgtttttcattatgtctgctgatcctcctcagtcatcatcaatcgatataatttttcatatgtattcacgaacatctccgcctcgtcttcatcaaaatacataatatatgatcggacgagttcctcaatccgccgctccacacggtgaaatacttccgtccccttttccgtgacatttaaaagtatgctccggcggtcgctttggctgcgttctctattgatgtagcctttttcatacaggcggttcgtcatagatgtaatggcgcttttattgacgtggcacaccgcggccagttcaattgatttgcaatcgggattgagcataatatagcggaggatgtaatattgatccaatgtcagttctttgttcactttttcagcgataatgctgtcaattttttttaagacgtgcaggtatacatcggaataacgctgaatcagctgctttactttttcttcatgcaccttttccccctccttccgatagttaatatgtttaactattaaaaaggataacgacttgacggtatcatgtcaatcttcaaaataaaataaagaaagacagtgcagattacaccgtctttaatgattcctttttttcttttgcttgtgatgagatatttaacagcgctaaaaatacagacacaatgccgcaaaaagcggataaaataaaaatcagccagcctgcatttgacatcagggcagcaaagatcggcggtcccgccgctactccgataaaccgcatgctgttataaaatgaggtaatggttcccgattcctcgttgtctacgccttctgtgatgacagcgtctaaagccggcaatgccattccgataccgataccgctgacacacaaaaagataaataataaataaaaactgtgattccaccataggccgataaacgacagtgtcacggcactcattccgaaaacgatgcaaaacttcattttgccttggtcttttccgattttcctgcctgctatatatgaactgacggatagaaataaaagcgggattgccaaaagcgctcctttagccacaccgtcaatgccgtatttcttctccagtgagtctgataaataaaaaagaaccccgaacagcaaaaacataatcacgcagccgatgataaaaaccgtaaagagccagcgtccgtcacgcttaaatatgcggccgacatttttcacaaattcggaaatagaaggcgcttctttttgttcctccggctttgccaccaaaaacaatacgagaaaaaaactgatgagcgaaaaaaacggaatgaaccaaaatggcataaaccaaaaccatgcagccaagagcgaaccgagaatcgggcttattactttcccggcagtgttagacgtctcaatatcgccgagccccgcggtaatccgctcatcatcccctttgaataaatcaccgataaacggcatcactacaggagccgcccctgccgaaccgattccctgcagcacccgccccgccaagataatgggataaggatgcttgaacgcggtggaagctatcgcggcaagcgctccgcccgcaccggctatgagaagacaaggcagaagaaccttttttcttccgaatttatcggacagatatccggcaatcggaatacaaataatcgccacaatcgaatagaccgttataattaacgatacttgaaaagacgatatggacagcttcttttcaatcatcggaagcacaggaatcagcatggaattcccgagtgtcatcacgagcggtacagaagccagagcaatgatatttttcgttccatttttcttcttactcaacttattcacccattcactatacttggttgtttcctgttttattgtgccttgcagaaaacaaagtatgtactgaaacggcaaataaaaaaacagacacatgacgcgtctgtcttaaaaacgttttcttacaacatgaaaactgaacttatcagcccggaaataatttaatgaatacagcacaggttcatcattctgattatagtgggtttgcttcagcaataaaagcgccgtctccggctcgcattccaaaaccggtgaaatcgtatcgtgatatccgatcggttcgatatcagcaacggcatagctgataacagatccggagtttttttccaaaagatcaaaaatagactcctgttcatgacagaaagaattcggcagaatgtgcatcggaatcgtatctaaacagtaaacgaccggagtgccgcttgccgttctcacgcgttccaaataaaaaagctcctgctcaggctcaagccggaatctagcgatatcttcatcagacggcgtgatgacctgagacgacaaaaaaatcgtacccggcaccatgttcgcctgctgaatcgttttcgtcacgctgttgagctgttcaatacctgaaagaaacagcggttttgtatggacgaaagtgcccacaccgtgccttctgataatcacatgctcctcttcaaggatacgcaaagcttcacgcagagttgcccggctgacacccattgattttgaaagctcaaattcagaaggaagcttttccttttcggtgtaaattccgttttgtatatcctctttgattcgctcaatcacttttagatacaagtgacgattgtcagcttttgtagacatgtttcccctccgtaaaccactttcataaattattgaacaattgggacaactatatcatgttttaataaaaaaataaataggaatgattttgggtgatatcattttcagtgaaaactctctcctttttaagaagagagctcatcatattgttccttagataatagtacttccctcggtttgcttccttcatacggcccgacgacgccccgttcctccattgcgtcaatcagacgggcagctctcgtatatccgattctgaaccgcctttggagcatggagactgatgccgtctgcatgccgataatcaaatcgaccgcttcgtcatagagatcatccgttacttcactgtgtgtttccgaaacttcttccggaatcatctcttcttggtactgcgctttttgctgcgtaatgacatgatcaacgacatgctcaacctcttcatcggataagaatgccccttgcacacgcaccggcttatttgcgcctacaggcagaaacagcatgtctccgcgccccagaagcttttcagcgccgcccatgtctaaaatcgtccgtgaatcggtctgagaggagacactgaaggcgattcttgacgggatgttggctttaataacaccggtaataacgtcgactgaaggccgctgtgtcgcgataatcaaatgaattcccgccgcccgcgccatctgtgaaagtctcgtaattgaatcttccacgtcggaagaagcgaccatcatcagatcggcaagctcgtcaacgatgacgacgatgtacggcagctcaggctgcttgacttcttcttcggcatttgaccgcttaatatgatcgttatagccttctatatttctcgtacccgtatgggagaacagctcatagcggcgctccatctcattgacgacctttttcaaagcctgcgaggcctttttcggatctgtcacgaccggcgcaagcagatgaggaatgccgttatacacattcagctcaaccattttcgggtcaatcatcatcatcttcacttcatgcggtttggccctcatcagaatgctcgtaataataccgttgacacagacgctttttccgcttcccgttgcccccgctacgagcaggtggggcattttgttcagttcggcaagcacggcttccccggaaatatttcgtcccaagccgatcagaagcttcgcgtccggcttgtcattgagcttggattcaagcacttcttttaacgaaaccatcgcaacttcagcattgggcacctcgatgccgattgccgatttacccggaatcggcgcttcgatccggatatccttcgcggcaagcgcgagcgcgaggtcatcgctcagattcacgattttactgactttgaccccgacgtccggatacacctcatattttgtgaccgccggaccgagatgaacctgcgtcactttcgcctttaccccgaagctttgaaaagtccgttcgagttttcttgcattctcgtaaatgtttttcttatcggtctgctggccggtatgtttcgggtcagccagtatgtccagtgaaggcatttgataatctttattttcaagctctgtaaacgtcatcggcggagccgcagccgtttcgccactgtcttgagcgccgccggaaggctcatcttttgccgcttgtgcagcctcctgcgttttttccggaatcagcggttcggcgggctcttcctgacggtctgaaaagcttgaaataatcggctctgaatggatgatcggcgaaatgatttcctcatcctcttcctccggttcaggctcttcttttttcttttgaacccgtttttgttttttgcccgattttgtttttgttttcggcgaagacatgttcgttctgaccgttttcatatcctcaagaaatgcctgccattgactgcggataaaccggccgacggggctcgtccactttttgagcgtttcctgcagtgaacggcccgttacaagaatcagccccattaagatcagcacgatcgccatgatttgtgaacccgttgatgcaaataaaaagtgggaagctgcaaacagtaccgcgccgatcatgccgccgcccaaatcaggggaagcagcctgctgtttcatgtcaatcataaacagctcccacgtgttgccgatgacacttgccgaccgaatcgacccgtgatgagacagatttttaaagagctgcacgtgagacagcagcaatatactggcgataatacagtacagccctgcctttcttctcgttaaaaggcttggactcttctttttccaaaacagcgaaattccgagaaggaagagcgcaattaagcataaaataaaccactctccggcaaaaaaacggaacaagtacacaaatgtctgtcccacaacgccgagctgcaaaacagcaataattgagattgcaacacagagcagtccgcttagttcgtattttagattgagcttactctcttgtttctttttagatttccgttttttctttgccacactcatcaccttactgcgttaaaaaatgtaaaatcatacatcatgaagaaaagcagccttttgccggctgcatttttctgtaggattcccctattatagcatattttgccccccgagaaacggactgaatgccggttagattttcagcttgattttttgtcccggagcgatgtccggattcagaaaatccatcgggttcgtacttaaaatctgtacgacttcagcttcatttcccttcatctcaactagcagcggcacgccggcgtaatctacctgttcatgcacgctttgctctatatcctgaccgtaaacgacttcttggggcatgacggtataaaggatcattgaatcatccttccttcctcgccctttcgttcctcaatcagctgattcagcttttttatcgcctgtccgacgccgcccacggcatcaattaatccgtaatcagccgcatctttcccgactacgttcgtcccgatgtccctggttaagtttccttttgaaaacatcagctctttgaatttttcttcggaaatatttgaatgatgggtcacaaagttgacgacccgctcctgcattttgtccaagtattcaaatgtttgcggaaccccgataaccagacctgtaagccgaacggggtgaatggtcatagtcgctgtttccgcgataaaactatgatcacatgacacggcgatcggcacacctatcgagtgtcccccgccgagtacgattgagacggtcggttttgataaggatgcgagcatttccgcaatcgcaagccccgcttccacatcgcctccgacggtgtttaagatgatcagaagtccttcgattttcggattttgctcaatggcgacgatttgcggaatgacgtgttcatatttggttgttttattttgcggcgggagctggacgtgcccctcaatttggccgatgatcgtcaggcagtgaatattgctatcttgggacatttgcggcagagatgtctctcccagctgctgaattttgctcataatgctgtctttcgcatctgatttttcgggctgctgttcttcggtgttttccatacgatgatccattttatctttcaccctttccgaatgtctctttgtattatgaacaaagatgatgatttccatccgggacatgaacaaaaacaaagccggagcatcatgcgctccggctttgtatacattatacttccataatgatcggaatgatcatcggcttgcgttttgttttttcataaaggaattgattcagcgcatcacgcattgcttgtttcagcgtggaccattctacggcagatgtttccgtcgcttcagtcacgatagagcggacgagctcagtagcttgtacaattagaccctctgattctctgacatacacgaaaccgcgcgtaatgatctcaggacctgatacgaggttctttttctgcttatcgagtgaaatcacgacgatgagaatgccgtcttgtgacaataagcggcggtctctcagcacgatgttgccgatgtcgccgactccgaggccgtcaatcagaacgtttccgtacgtgactttatccccgattttcacattctggccgcggaattcaacgacgtcacctttttcaatcaagaaaatgtcgctgcgtttcatgccgatctcttctgcgattttggaatgcgctttttgcattctgaattcaccgttaaccggaattaaatatttcggtttcagcaaattaagcatgagtttcaattcttcctgcgaaccgtgaccggacacatgcacgcgcttttgggcgaaaatgacttgagcgccggcgcgggcaagcaggttgacggttttggaatatatcaattcatgccccggaatcggtgttgatgcaatgacaacggtgtctccttcttcaatgttaagctgcttgtgcgcctgcttggccatccgcgtaagagcggccagcggctcaccatggcttccggctgtaacaattgccacttcccgcttcggatattttttcacatcctgcacaggaataaacatttcatcttcggcttcaatatagccgagcttgcgcccaagctgaagcacgttttgcagattttttccggcgattgcaagtttgcggccgttctggacggcagcctgtatcacttgctggatccggttgatattagacgcgaatacagcaatgatgacacggttttctgaattgttcatcgcatcggaaatttcaccgcttacatatgcttcggacggagtataccccgggcgctccgcattggcgctgtcagaaagcagggcgagcacgccgctgtttccgattttggcaatttcgccaatatcacatgattggtgataagcaggcgtctggtcaaatttaaagtctcccgtgcatacaatagagccaagtgatgttttgaagctgactcccactgaatccggaatactgtgaatcgttttaaagaacgatactttcgttgattcaaatgtaatgactgatttagagtgaacttcacgcaaatcagcttttcgattatgcccgtactgcttgagtttttctctcagtaatgcaagcgtaagcttcgttccgtataccggcaccgacagcttattcaataaataaaagacgcccccgatgttttcatcgtgcccgtgtgtcagaaagatggccttcacgcggtcagcccgttctactaagtaggaaatatccggaatgacgacatcaataccgagcatttcattttcagggtgcatcagccctgcatccactacaaatatgtctgagtcaatttcaatgacatataggttcttcccaatttctccaacgccgccaagggcgataattctgacgttttctgtatttttctttttcaaaatctgtatcctcctagtctcatacccgtccatcatcacttgttcctattataactgatatcaattttagaaaacaagaagaagcggaaggtttagggaaaaccaatatgtatacaaaacggtcaaactcacgataaaaatgagaatgaccgcgtattttaactgtataaattttttcttacagttcgctgatgacgctgctcaggctcagacgttcatcttcattcagcgggataagaggaagacgcacagatccgacatcaaggcctttcagctgtagcgccgttttgaccggagccggattaggcgctttaaagagctccttcatgatcggcagaagcttctgatgaatcagtgccgcggttgccgtctgcccgttcgtatagtttttaatcatctgctgcatgtcagaacctacgatatggctggccactgacacgactcctcttccgccgactgcgagaataggaagcgttaacccgtcatcacctgaatagacgtaaaaatcttccggtgtttcggcaatgattttcgtaatggcatcaagatcgccgctcgcttctttaatcgcagagatattcggaatctccgcaagtctgatggccgtttccggcgcaagcgaagcgaccgttctgcccggcacgttgtaaagcatcacaggaagagacgtttcttcagctatggctttaaaatgacggtacatcccctcttgggaaggcttattataatacggcgtgacaagcataacgcaatcgacgccggcttcttcagctttttttgtcagtttaatggagtctttcgtattgttgcttcccgtacccgcaataacaggcacgcgtccgttcacttctttgactgtaaattcaaagagtgcaattttttcttccgttgaaagtgtcggggattcgccggtcgtgcctgcgacgactaaagaatccgtgccgtttttcaacaaatagtcgattaatgtagacagtttttgaaagtctacattccctttactgtcaaagggggtaatcatcgctgtagatatatttccgacattcatttttttcacctcatcatgattcaatcacatttactttgaaagttcaaacacttcatgcagcgcatttacggccgttaccatatctttttcatgaacgagcacccagatcgtcgtatggctgtcggcagattgcagaatcggaatgcctttatcagaaagtgcggagacgattttagacgtgacacccggaacacccattattccggcgccgaccgctgacactttcgcacagctttccgtcactgtcggctcatatcctaattcagccaaaatgctgcgcgcggcttccgttttactgccggctacggtatatacgatttcactcggcgtaatgttaaagaaatctacgctgattccggcatttgccattgctttaaagacttcagtctgaacgttgtattgccccattttggcgggaaccttaaattgcgtcacatctttcacatgggcgatccccgtgatcagccgttcgaatacatcgctgccgatgttagacgaatgatgggacgtcaccaaagtgcctttgtcttttgaataagtggagcgcacgcggatcggcacctttgcctgcatggcgatttccaccgcgcgcggatgaatgactttcgcgccttgataggcaaggttgcagatttccgtatatgtgacgttcggaagcggcttagcattttccacgattctcggatcggctgtcataacgccttccacgtccgtaaaaatgtcgataaactcagcatctaccgccgcgccgagcgccgctgctgaagtatcgcttcctcctctgccgatcgtcgtcgtgtcgcctttttcagtcgctccctgaaatcccgcgacaacgacagcgtcatggctggcgagtgcagcgaaaagccgctctgttttcatttctataattttggcgtcagtatgctgggcattggttaaaaagccggcctgggctcctgttaaagctgcggcttttatgccgttttccttcagcatgctggaaaaaacaacggacgaaatcgtttctccgcaagacagaagcatatcctgctctctcggagaaatgtcggactggctgccgtaaaggagcccgattaaagaatctgtcgcgtacgggtctccttttcttcccatcgccgatacgacaacaacaactttataaccttcactgatggcatctttaatgtgtgctagcgcaagcttgcggcctttgtcatcttttacggatgttccgccgaatttttgaacaatgatcttcactattttcactccaaattagtctgacgtaacagaagagagcaggcagagccttactctcttctgttcgcctatagaaaatacgtttgttttatacgaggttcagtttttgcaggctttccgcgatttgaactgagttccaagcggcgccttttaacaggttatcagaaacaacccacaaatgaaaaccgtttgctctgtccaaatctttacggattcttcctacaaatacatcgcgtttgccgacgcaatcagcaggcatcgggtaaagctgctccgccggatcatcctgaagcgtaacacccggagcttcttttaaaagctgtttaatatcttcaacggttgcgtcatcacggtcaagctcaatgtaaacagattctgagtgccctgtttcaatcggcagtctgacacatgtcgcagccacttccagcttcggcatatgcatgatttttttcgtttcattaatcattttcatttcctcaaacgtatagccgttatcttggaatttatcaatttgcggaatggcgttaaatgcgatttgataatgctttttgtcgcctttaaccggcataatggacggttctgcaggttcattgtttaaaatcgcctttgtctggctgtacaattccttcgccgcttcattgccggccccggacacagcttggtaagtagatacaatgacttttttcaaaccgtacgctttgcggatcggttcaagcgcagccaccatctgaatcgttgaacagttagggttggcgataatgccgttatgtttgtgcagatcaccttcgttcacctcaggcaccacgagcggtgtattttcgtccatccggaatgcgctggtattgtcaatcacgatggctccccgttttacagcctcaggcgccaagctttgtgatacgcttccgccggcgctgaataacgcgatatgaacgccttcgaagctttcaggaacagcttcctgcactgtatattcttcgcctttaaacgttactttcgtaccagcagaacgctttgaggatagtagtgtgagtgtttcgatttcaaagtttctgtcttccagtgttttcagcatttgctgtcctacggctcccgtcgctccgacaactgctacgtgtaatcctcttcccatctgtaaaactccttccgccaattaagcatcatttgttgaattgactttgcattttacgttttattttaccatagaatagtcacggattgaccgaatttttttattccggaatgattttctgtcatcatgattttttattcatgatggtgtacgagcaccggctgaacttgctggtgcaaaagagctttttctaccgtaatcggaaggagatccattctggcgacgagcgatgtcggttttttcacgtggtcgtcctggccgaacgggatgaaatatatgttttttgcggacatcagcctcattaaattcgttccgtttaaaccgagtccgtcgtttgtcgaaattccgagcacgaccgggcggccgttgcggatcgtggctttcgcagccataaggacggggctgtcagtcatcgcatttgcgagtttgctcattgaatttccggttaaaggggcgatgaccatgcagtcgagcggaagtttcggcccgagaggctccgcttttacgatggaatcaatcgcctcaaagcctgttgcttcttcaatttttctgacccaatctcccccctccccaaagcgggtatcggtcgattgaacggttgatgtcacgaccggccggacttcagctccttgactgataagcgcctctatttgcggaaaaacttcctcatatgtgcaatgcgagccggttaatccgaatccgattcttttccctttcagagacatggttatttcccctctttctttaagtctgccaaaagcttgctcaatacgttcgcaataatctgtccggctgttttcggggccacaattcccggaagacccggagcaagcagcgctttaatgccttgtttttcagcatatttgaaatccgttccgcccggacgggatgctaaatccaaaatcaaggtcttcggcgtcatgcgcgataaaacgctttgattcagaatcaagctcggtacggtgttaatgcagatatcaatatcatttacatgttcagtaagctcttcaagttgaaaaggagaaagccccatttccgttatacgggccaaatgagccgaactccgcgcgcccacttttaccttcgcccctaacgccgcaaacgtccgggcgatcgtcataccggtgcgccccatgccgagaacggcgacatttgatccgtgaatggtataatccgtatgctgaatcgccatcatgattgttccttcaacagtgggaatcgagttgaatatcgcgatatcgtcccgttcaaataatttcacaagtttgcggccggcttcgctggcgatcccctcaagatacgcgttggagatgcctgaataaatgacgcaatgctccggtgtccgctcaagatagctctgctttaataccacttcttcatttgaaaaaaccgtggaaacaacgccttctccggtcgttgccgatacgggcaggatgatactgtctattttttgaaagggaatctcatcgattttgcatttgacggttcctgtaaaaccgtcatccaattggtcaaaccctgcaagataaatatcggcatgctgttctgtcagctttcttataatctcaagctgtcttgcgtcaccgccaatgatcgcaattgtcaatccggttaacatctgaaacgttcaccttctttacagttactggatcttttaagtgtcatcctcctcttcatcgtatgtgcaaagagaaagggcggtgaatgtacagcgtctttttcatgaaaaaagcaccggctgtatgagccggtgcttgcaaaaaatgaataagatctactcttcgggaggcgtgatctcccccggaacgtctaaaatgatcatgtctgatccgattttttggatatgattccaggggacgcggatgtcgtggccttgttttcgcaatccgaaccattttaccgtcggtatcaacagcgcggtaatttgtccgtcctgttcattaatttccaaatcggtctggccgagcacgccgagccgctctgcccgtttaatgtccacaatttctttacctgaaagttcactgagcctcatgatagccacccccttgtactatatgacccggagcaaaaaaaaatgcctgccccgtatagaggcagactgcttttccgattaagacgaggccggcatattgccggtcgggctgatgagcgatagtgcgtaatcatccgtaaataagcggcggctgaggccgttgacgctttccaggctgaccgcatttaattcagtgataatttcatccatggtcttatgctttccgagcaggagttcgtttttcccgttccggctcattttgctgtttgtgctctctaagctgagcattaagctccccttcatttgctctttgctgttttccagctctttcggggtgataccgtcacgttttagaaccgataacgtttcctgaatggtttcagacagaagtccgagctgattcgcgccggtgcctccgtaaatcgtcagcataccgctgtcttcataggaactgtgatagctgtatacagaataggccagtcctttatcttcgcgcacatcctggaaaagacggctgctcatgcttccgcccagcacgttgtttaagacgatcaaatcgtaaatgtccggatctccgactttcaggcctttgaaaccgagacagagatgcgcctgttcggtgtctttttttctggtcagcttttcataatgaaactcaggctcgctgatgccgcttgctttgcccttcgcttcgtatgtaccgaaccatttctccacgtctttaatgaattgttccgttacatttccggcgacagaaatgacgacgcggtccggcgtgtaaaagtcatccatatgctgtctgagagaatcgccgttaaatgacgaaagcgtttcctccgtcccgagaatcgggtagccgagcgaatgattgccgtatgtcgctttgctcagcagatcgtggacaatgtcatccggcgcgtcttcatacattttgatttcttcatatacgacgttcttttcttttttgagctcatcttcgtcaaaagcagaatgaaagaacatatcagccagcacatcaagtgcgtagtttgcatgctcatccagcactttggcgtaatagcacgtatattcttttgaagtgaaggcattcacttggccgcctatccgatcgaaggattctgcgatttcccgtgcggacctggtatttgttcctttaaaaaacatatgctcaagaaagtgcgaaataccgtttgtatccggcgtttcatgacgtgaccccgtcccgatccagacaccgattgccacagaccgcaccgttggattattttcaagcacaactcttacaccgttttggcatgtatagcgttttatcaagtctgttcctcctattcaaaagacaggcaaactgccgcctgctacttcatcagcctgttttcatccattaagtcagacactgagccgagcgcgtagcctttttctttgatttttgcaatcagtgtatccaggcttttcgcagtcggatcagtcggatgcattaaaatcatggctccattatgtattttgctcaacacccttgtttgtaaaacagccggagacggtttttgccagtcaatggtgtccacggtccacatgatggtgcccattcctttttccgccgcaagatcgaccacggcttttctgaagctgccgcttggcggcgcaaaccatttcggctttatgcctagcgtctcgctgatttgtgcattggttttgtcaagctgttcggaaatgcttcctgaagtcagtttgctcatatcagggtgattgtatgaatgatttccgatttcatgtccgtctgccgctatttttttccccagttcctgattgtttttcagccatttcccttcaagaaagaaagttgctttgacctggtgctgcttcagaataggcagcatttgctccacgtattcatttccccaggcgacatttatcaggaaagcgaccatcggtttgtcgggatttcctttataaatgggttcgggcgcgagagaatcaagatggactttcggttttacctgctcatagacaaggccgtcttcgtgaaattctccgtcctttttcatttgttcataggatttttccacattgacttttaaaccgttatatcccggtatactcttccatattttatcaatccgcgcgtcttgcggcttcacttcatactctgacgctttttgcagtaattcttcatagagcggatcttttgatgctgacacagttacagcgtcttttttcattgcgtctatgtaatcaactgtatacgggttttttaacatttcaaacgaaacaaaaaaaagaaataaaaaaacggcaaacggcacgaattttttcaacatgtccttcccccctcctcacacattatgtatgaggaggacaaggtagaacccgtctgttgtctttctcaaaataaagaagccgggtctcccaggctccttgttaggttttcatttaagattgttgttgttcctgttctttttctttctcttcgcgcagcactgctttacgcgacagattcactcgtccctgtttgtcaatttcagttaccttcacaaggatttcgtcaccgattttcacaacatcctcaaccttgccgacccgttcgagcgctagttcagagatgtgaacgagaccgtcttttccgctgaagatttcaacgaaagcgccgaatttctcaatccgtttgactttaccgaggtaaagctggccgacttcgacttctctgacaagatcttcgatgatttttttcgctttttggttgctgctttcatcagtagaagaaataaagatggtgccgtcttgttcaatgtcaattttaacaccggtatcttcaatgattttgttgatttgtttaccgctcggtccgataacgtcacggattttatccggattaatgttcatcgttaaaattttcggcgcatattgagaaagttcttttcttgattcaccaagcgtgctgagcatgctgttcaagatttccattcttccttttttcgcctgctgaagcgcttcttcaagaatttctcttgaaaggccttcaattttaatgtccatttgcagcgctgtcacgcctttttccgtgccggctactttaaaatccatgtcaccgagggcgtcttccatcccttgaatatccgttaataccgtatagtactcgcctgatttcacaagtcccatcgcgatacccgcaacaggggctttaatcggaacacctgcgtccatcatggcaagcgtgctcgcgcaaatgctggcctgtgaagtggaaccgtttgattcaagcacttcggatacgagacggaccgtatacgggaagtctttttcattcggaatgaccggctcaagcgcacgctctccaagagcaccgtgaccgatctcacggcgtcccggtccgcgcatcgggcctgtctcccctacgctgaactgcgggaagttataatgatgcataaagcgttttgattcttccacgcctaaaccgtcaagaatctgaacgtccccaagggcgcctaatgtacaaacgctgagcgcctgcgtctgtcctcgcgtaaacagcccggagccatgcgttctcggcagaaggccgacttctgaagaaagcgggcggatttgatcaacgccgcggccgtccggacggactttttcttctgtgatcaaacggcgcacttcgtttttcacgagtttagacagtgtctgtttcacttttttaatcgtatcttcatcatgctcttcttcttcgaatttcgcgacaactgcatttttcacttcattgatcgcgtcttcgcgagcatgtttttcgtgaacctgaatggcgctgagaagatccggctccgcaaggctttttactttttcgctgagctcttcgtcaatttcatacagttcgatttccgttttctctttgccgactgccgcgacgatttcttcttggaatgcgatcaggcgcttaatttcttcgtgaccgaacataatcgcctcaagcatgatttcttcaggaacttcatccgctccggcttccaccatgttgatggcgtcttttgtgcctgcaacgatgaggttgatatcacttttttcaagctggtcaaccgtcggattgatgacgaatttcccgtcaatgcggcctaccgtcacacccgcgatcgggccttcaaacgggatatcggaaacgcaaagagcgagtgatgaaccgaacattgcagccatttcagatgagcagtcctgatcaacactcatgacaatgctgatgacctgtacttcgttgcggaatccgtctgcgaaaagcgggcggatcggacggtcaatcagacggctggctaaaacggccttttcacttggacggccttctcttttaataaaaccgcccggaattttacctactgcatataatctttcttcatagttaacggtaagcgggaaaaaatctagcggtttcggttcttttgatgcggttgctgtgctgagcactgcagtatcgccgtagcggaccatgacagcgccgtttgcctgtttggcaagctggccggcttctactgtaagctgtctgccggcccaatctatggtaaagacatgtttctcttgtcccattcgattacgagctcctctcttaatgtgtgaaataatcaattactcctattatgaacgaaatgaattgaacatatcaatgtcaaagtagtatgtaaaaggatttcattgttttttatcattatttttttcgctttaatacgataaaaaagcgggaatcctcccgctttttacgattatcgacgtaagcctagtttgttaattaactcacggtaacgagttacgtctttattacgcagatacgtaagaagattacgacgtttacctaccattttaagaagaccgcgacgtgagtggtgatctttcttgtgagtacgcaaatgctcgttcaagttgttaattgagtctgttaggatagcgatctgaacttctggagatccagtatcagattcgtgtgttttgaactcactgatgagttgatttttacgctcttgagtaattgccatcctgtttcacctccatatcataattagccccagttacctagcaaccgtcggtgacttcggattgccaagcaatggttttaagactacgaaacatatgatactaaaaatcgcgcccatatgcaaatcttttagaagaaaatttgtgtacttttgatgttttttccgttatttgctgaaaaaacggatcgcttcttgtttgtctttcccgatctgagccgtcagttcatcgatgccgttaaacttccgttcgcttcggattcgtttgtaccactcgattttaacgtcttctccgtatacatcctgttgaaaattaaacaaatgtacttcaattgacggctgatcgggacgcttttcataaaaggtcggtttgtagccgatgttgcagacgccttcatacacctcgccttttatttcggctttcactgcatacacgcctgtcggcggcacgatataactgttgtgcaggccgacattcgcggtcggaaaaccgatggtgcgacctcttttgtctccgtgaatcacagtgccccggacaaaatacggctggccgagaagagtgtgcgcaagttcaacgtcaccatcctgcagcgctgaccggatataagtggagctgatctttctgtcctgctcggtctgtttctcgacagtcgtgcatccggccttgccgtttaaatcgtccggcagcgtctccatcgtgccttttccgtattttccgtacgtaaaatcgaagcctcccacagcgtgccgcgcgtttaaccctaaaatatactcctcggcaaactgttttggagacagagacgcaaacgcttcatcaaactttacgacatacagcacatcagcgcctaaacgcccgatctggctgattttatcttcaagcggcgtaatcagatcctttggctctttgtccctgcccaacacatgggaagggtggggatgaaacgtcataacggccagcgacaggcctttttcttcggctatttgtctggctgttccgattactttccggtgtcccaaatgaacgccgtcaaagtagccgagcgccatgacagacgccggctgctcttctttttgtaaatgatgcggatgagaaatatgtatcgtcttcacagaacggtcaccttttttcttattgttcgcttttttgcatgagcactttagccggtttcagcagtcctttttttgaaggatgcggcatataaatggccacacattctccgtcttcagtacagagcgctatacgggcgtcagctgtcattgcagaaaattccgccgggatgtcaaacactgacccgttttcagctttcttagctaatgtatcacttatgacccatttcggcaaatgattgagcgctctatcgatcggcacggcatgctctgcaaccgttccgtctgaaacctgctgttcaagttcctcaaacgtgaaacactcatcaaggctgaaatcgccggaagcggtgcggatgagatgcgacatatgcgcgggatagccgagtttttcaccgattgtcaccgccaatgttctcacgtaagtgccctttgagcacgtgactgtaaagcggaatgatgctgtgtcttctttataagtgacaggggaagtgagcgcgatatcttcaatcgtgatattccgcttcggccgctccacttcaataccggctctggcgtattcatagagctttttcccgttgacctttacagcggaatacatcggcggcacttgctcctgcggtcccttcagttcgtctaaaacggctttgatatccgcttctttcagcggctccttgacaggttttacgctgaccgtttctccagtctggtcttcggtcgatgtggagaagccgagagtgatctcagcatcgtacgtttttgacttgtcggtgacgtactcaacaatctttgtggcccgtccgacacagatcggcagtacgcctgacacttccggatcaagcgttcccgtatgtccgactttctttgtttttaacagttttcttattttcattacacagtcgtgagaagtcatgccgaccggtttatgtaaaaggagaactccgttaaccatatgtctttcgctcctttgttatcaattgtatcccgtaaaacgcagaaaagaggacagacgacactcgcccatcctctttccttgttattcagacggtttatctgaatgcagttcgtgaatcaatgtttcaatacggttgccgtactcaattgattcatcaaattcaaattcaagctcaggcgttttgcggagtctgattcggctgccgatttcggaacggataaatcctttcgctttctcaagccctttcagcgcctcctctttctttttctctccgccgagaacggagatatacaccttcgctatttgtaaatcacctgaaacacgtacgtctgttacagtgagaaatccgattctcgggtctttcagctttcggctgataatatccccgagctcttttttcatctgctcgccgacacggtttgctctcatactcaattcaatcacctctaagttaaaaccactctgttctagtgatcgtccgttctatttcgggaaaggagtcaataaacgcgagtacgcgctggatctccttttccgcctgaacgtgagaggaggagacgacagcgattccgaagctggtccgctgccaagtgtcctgatagccgatttctgcggccgacacgttgaacttattctgaaccctcgttataatccgcttcagaacggctcgtttctcctttaatgatcccgcatcataaatgatgcattcacattccgcaaatccgatcactttctttcgatttcctgcatgacatacgcttcaatgatgtcgccttcgcgaatgtcattgtatttcttaattgtaataccacattcatatccttgtgaaacttctttcacatcatctttgaagcgtttcagaacgtctacttccccttcgaagatgaccacgccgtcacggatcaggcggagtccgctgtcacgtgtaatgtggccgtctgttacatatccgccggcaatcgtgccgattttcgacactttgaatgtttggcgcacttcaacctggccgatgactttttcttcgtattcaggatcaagcattcctttcatcgccgcttcaatttcttcgatgactttgtaaatgatacggtgaagacggatatctacattttcagcttcagccgtgctcttagcatttccgtctgggcgcacattaaacccgataacgattgcatttgaagcagatgcgagaatgatgtctgattccgtaatcgcaccgacgcctgtgtgaatgattttcacttttacgccttctacttcaattttttgaagagcggctgttaacgcttcggctgaaccttgaacgtcagcttttacgattaaattgatgtctttgacatcgccttgtttaatttgttcaaacagatcatcgaggctcagcttcgctttgtcgctgcgctgttcttccagttgcttggaagcgcgtgcttcaccgacagaacgggctgttttttcgtctttaaagacgaggaattgatcgccagcctgcggtacgtcgtttaagcccgtgatttctacaggtgtggacggtccggctgttttcacgcggcggccgagatcattgaccatggcccgcacgcggccgaatgtatttccgacaacgatcggatctccgacattcaatgttcccgtttgaacgagaagtgtcgcgacagaccctcttcctttatcgagctcagcttcaataaccgttccttttgcctgacggttcggattggctttcagctcttccacttcactgacaagcagaatcatttcgacaagctcgtcaattcccttgcctgtaagagcggacagaggaacgaaaatcgtttctcctccccatgcttcaggaacgagtccgtattcagtcagctcctgcatgacacggtcagggttcgcgctttctttatccactttattcacggcaacgataatcggaacctcagccgctttcgcatggttgatggcttcgactgtctgcggcataacgccgtcatcagccgctacgactaaaatggtaatatcagttacttccgcaccgcgtgcacgcattgttgtgaacgccgcgtgtcccggagtatctaagaacgtgatttttttgccgttttcttcgatctggtaagccccgatatgctgggtgattccgccggcttcaccttcaacaacttttgtttttctgatgctgtcaaggagggtcgttttcccgtggtcaacgtggcccatgatcgtcacgacaggcggacggatttgaagatcttcttctttgtcagcctcttcatatttttcaagctcagtttcttcaagcacaatcacttcttctgtttctacaccgtattcagatgcgatcagttcgattgtgtctttgtcaagctcctggttaatggtagccattacgcccagaagcatcagttttttaatgagttcagacggctctttgcccagttcctcggctaaagctccgactgttaaagagccggaaaacgtaattttctcaggaagctcttttttcggcttcagcggtttttgctgatactgatttttgttgttatgattgcgtttgtttttgtttttgttgttgttgttattcttcttgtttttgttaaattgattattctgcacgtcattcttctttccgtctcgaattttgtttggttgattcccagcaggctgctgattaatcccttgcggcttgtttttgttcgtttccgcaggcttctgagatgtaacgccggcgccgccttttttaaatttcgcatcaagctgcttaatggtcttttcttcaagcattgccatatggttatttactactatatccatgtttttcagcgcagtcaaaatttccttgcttgaaacattgatggcttttgcatattcgtaaactctcattttagccattcgttcacccccaaaaatattaatcgagcaagctgatcagcttattcgcaaaaccttggtcagtgacggcgacaacgacacgtgattccttgccgatagagcggccgagatcagcgcggctttcgacttttttataaggcactttataataattgcatttatcggatactttttttgcagtattcgcagatgcatcttctgtcagcagaacaagttttgcacgcgcatttctaatttcttttataaccaagtcctcgcccgacacgaccttacgagctcgattggccagacccagcaagggaaaccattccattccagacatgttattttttcaccttttccgccagttccagcaattcttcgaaaatctggtcatcgatttgtgattgaaattgattttgcaatgtgtttttctttttcgcagctaagatgcattctttctcaagggtgatataggcaccccgcccgttcttctttccggtcggatcgactgaaatctctccttctttagaacggacaattcggatcagttcctttttaggcttcatttcccccgttaccacgcatttgcgcagaggaattttttttcgcttattcacctaaagtcacctcttattcatccgattcggctgtttcaggctccataaagagcggctctaaatcgtcatcttcttcatgctctctcggatagatgccaaggtctcttgcatccgtttcacttttgatatcgattttccagcctgtcagtttcgcagctaagcgggcgttttgccctctttttccgattgccagagaaagctggtaatcaggaacgatgacattcgtggctttttcttcttcgctgacgatgacatccagcactttagacgggctgagcgcattggcaacaaattcaaccggatcatcagaccagttgacgatatcaattttttcgcctttcagttcattgacgatcgcctgcacgcgctgacctttaggaccgacgcatgaaccgaccggatcaacgtcagggtcatcagtgcggacggagattttagagcggtcgcccgcttctctggcaacggatttcagttcgaccgttccgtcataaatttccggcacttcgatttcaaaaagacgcttcaacagaccagggtgcgttcttgatacatagatctgaggcccttttgtcgttttttcgacttttgtgataaatactttaatccgatcgtgcggtttatagctctcattcggcatttgttcattgacgggcagcagcgcttcaatcttaccgagagacacgtaaataaacttgctgtctaagcgctgtacaattcccgtcatgatgtcttcttcacgatcgataaattctgagtaaatcacgccgcgctcagcttcacggacacgctgcgtcaccacttgtttcgccgtctgcgcagcaatgcggccgaagtctttcggcgttacttctatttcaacgacatctccgacaaggtagttcggatggatgtgctgggcgtcgtcaagcgagatttcaagtcttgaatcgtatacctcgtctacgacatcctttcttgcgaacacgcggatcgtgcccgtctcacggttcagatcgacccgtacgttttgcgcctggttaaaatttcgcttatacgcggaaattaaggcagcttcaattgcttcgatgataatgtctttactgatgcctttttctttttcaagaatagtgagagcatctaatagttcactgctcatgttagcggtctccccccttaaacactaatacttcattcattaaaatgttacagctaatcttgcgttagctattttttcatacggaatattgacccgtttctttcttgttttgaccgtcatctctattgtaacagtttgtccatcgaattcagccaatttgccttcaaacacttttaaaccgtcaatcggttcgtacgttttcatgtacacatttttgcccagtgatttttcgaagtcggcttttttctttaatggacgctcggctccaggagaagatacttcaagaaagtagttctgggtgatcggatcggcctcatccagcttttcgcttaacgcttcgctgactttggcgcactcctcaatatcaacaccgttctcggaatcaataaacacgcgaaggaaccagttttgaccctctttgacaaattcaatgtctacgagttcaagctgaaggtcatccagtatgggctgagccatttcttgaacggtatcagtcacttttttgctcatgtttttcctccttgtgctgtcgatatcatatcagccgttcctctgcataaaaaccctgcttcaaaagagcaggggcattgagaaaacgatggacatgtcgaggcaaaattgcctgttcaatacaaaagagcgggtttccccactctttgcctcggtaatcgttagcatttccaataaaactataccataaccatatatttaatgcaaatcaaactccgctcggaggctgtgcacaaagcttaaaacagagacagctgattttggtccggaagcgactcaagacagccgtgacggtctaaatactctaaaatggtttttgacacttttccgcgtttttgaagatcctcttttgaaaggaactccccttctttccgcgctttcacaatattgagagcggcgttggttccgagtcccggaattgagttgaacggcgggatgagactgttgccgtcaatgataaattccgaagcgctcgaacggtatagatcgaccttctggaaggaatagccgcgctcacacatttcaagcgcaagctctaacacggtaaggaggtttttctccttcggcgaagcatcaagccctttagagctgatatcatccatcaccgctctgatggcggtcgagcctttaatcattgtatcaatgtcaaagtcatctgcgcggacggtaaaatacgcagcataatataaaagcgcgtgatgtactttaaaataggcaatccgcaccgccatcagcacgtatgcggcggcgtgagctttcgggaacatgtatttgatttttttgcatgaatcaatataccagttcggcacattgttctttttcatttcttcttcccattccggcgtcaggcctttgcctttacggacgaattccatgattttaaaggccagtgaaggctcaaggccctgatagatcaagtaaaccataatgtcatcacggcagccgatcacttcgctcagttcacacgtattgttgtgtatcagttcctgcgcattgccgagccatacgtccgttccgtgagaaagtccggaaatctggacaagctcggagaacgtagtcggcttcgtatcctcaagcatctgccgcacaaatcgcgtcccgaattcaggaatgccgagcgtccccgttttacagccgatctgctcttcagtgacgccgagcgattctgtgccttggaaaatcttcataacttccggatcatctgtcggaatcgtcttcggatcaattccgcttaaatcctgaagcatccggatgacggtcggatcatcgtgccccaatatatcaagcttcagcaggttgtcatgaatggagtggaagtcaaaatgagtcgttttccattcagaccccgtcgcatctgccgggaattgtatcggtgaaaaatcgtaaatatccatgtaatccgggacaacgataatcccccccgggtgctggccggtcgttcttttaacaccggtgcagccttgcaccagacggtcgatctccgcgccgcgcatgtgcaggttgtgatcgcccgcatagcctttcacatatccgtaagccgtcttttccgcgacggtgccgatcgttcccgcgcgatacacgttatcttcaccgaacaatactttcgtgtagttatgggcatgcggctgatactcacctgagaagttcaaatcgatatcgggtactttgtcacctttaaagcctaagaacgtttcaaacgggatatcatgtccgtcctttttcaaaggtgtgccgcaagacgggcagcttttatccggaaggtcaaaaccggaaccgactgatccgtcattaaagaattcggaatatcggcagctcgggcacacgtagtgcggagcgagcgggttcacttcagtgatttccgttaaggtcgccacaagcgatgaaccgacggacccccgggagccgacgagataaccgtcatccagagaccgttttacaagcttatgagagatgagataaataacggcgaacccatgaccgatgatactttttaattctttttctattctcgcttccacaatttcgggaagctcttcaccgtaaatgcttctggcgcgctgatagctcatttcacggatttcttcatcagccccgtcaattttcggcgtgtacagatcgtctttgatcggtttgatctcatcgatcatcgaagcgactttctgcgtattgtcaaccacgatttctttcgctttttccgcaccgaggaaggagaaagcctccagcatttcatctgtcgttctgaagtgcactttaggcagttcgtgtctgtttaacgggttggcgccgccttgggaagatattaagatcttccggtaaattttatcctcatcgtttaaatagtggacatttcccgtagccacgaccggcttattcaatttttccccgagcttcgtaatgttggcgatgatttctttcagcgctttttcatcccggacgagctcaagctgcagaaggtgtctgtatacttccggcggctgcacttcaagataatcatagaaggatgcgatatcttcaacctcttcaggagatttttgcatcatgccttcaaagacctcacccctgtcacaggcagagccgattaacagaccttctctgtatttattaagctgcgacctcggaatgcgcggcactcggtagaaatattgaatatgagaaatggacacgagcttaaacagatttttaaggccggtctcatttacggcaagcaatgtagcgtgataaggccttgatctctgataagcattggattgtcccatattctcattcagctgatcatgataaaaaatgtctttttcagcggcatctttgagcattttcaacagcaggtagcccgttgcttcagcgtcaaaaaccgctcggtgatgctgggttaattcgatatcaaacttcttacataacgtatttaagcggtgatttttaaactcaggatacaggaaacgcgcgagttccagcgtatcaatgaccggatttttcgctttttccgttttcaaaagacgcttgtacgctacatttaaaaatcccatatcaaagctggcgttatgagccacaagcacgtcatcgccgatccattctttaaaatcccggacgacatcaacgacatcgggagcgtcgcggaccatgtcgtcagtaatcccggtaagctctatcgtcgttgctgacagcggatggtgcggattggcgaacgcttcgaatttatcgatgatttctccgcctcttattttgactgcggcaagctcaatgatggtgtcatacactgcggacagacctgtcgtttcaacgtcaaagacaacgtatgtgtcttcttccaggagacggtgagctggattgtatgcgatcggaacgccgtcatctacgatattggcttccattccgtaaatcattttaatgccgtgttttttcgcggcggaataggcatccgggaaagactgcacaacggcatgatcagttaacgcaatcgcttcatgtccccattttttcgcctgttcgacaagctttccgatgcccgttacagcatccatttggctcatcggagaatgcagatgaagctcaacccgtttttcgccttcaggagcggtgtcttcacgggttttggcttttatttcattcacgtcatttgcaatcatgacgaggtctctgacgaatgtatcgttttgaatgcttccccgcgcctttacccacatgccttttttcagcgttttcatcaaagcggcgtcttctttttctctggcgaacatttttactaaaatgctgtttgtatagtccgtgattttgaaaatgcagagcgtgcgtccgcttttcagctcgcgtgtttcagcatcaaacacaaacccctgcaccgtaattcttctttcttcatccatgatgctgtcaagcgtccggatttcttcgttctctttaatttgatagccgatgacaagcggtccggacggtgcctgatcctcatcgccctctttttccttcttctccatctcgataagcgcctgcatcgcccgctcctgatcttcagcaagcttttgctcgcggaatttctggacttcttggtcagatacgaaaatttcggtatccagctgcagttccggaaagccgaattggcggtagctgtgctgaatcagcgcgaagtatttatttttgagcgcagatgcttctgtatctgtttttgttttcacgatcagtttgtttcccttgagcttcggcttctgctgattcaaaagagccaccatcggcggcgaggttccttcaagctcttcaatacagcgtgtccaataatcctgtacaagctcctctgtcactgtagggtcgatgacctgaacagacgatgtgacacgggcgatgtgagcaaacgattgtgttaacctcatcatgaatgaatcatatatttgatacggcaaaagagccttaaagcgaaattggaaatgccaggccttttctgctttatggattgtcagtttatcaatctctccgtcttcaaagtatgtcatgaaggtatcatctgtcatattaagctgctgcagaagaatctgaaactgtcttctgtttactgataactgttccattcagacagtatccctcccttaaaacatcataagtgaaggtacctccgcaggtgatgaggtaccttcttttttctctattttaacatgattttgtatgattcgttatggtgattacttcgtcttgataaattcagaaagctcatccactgaaacttcggcagattcaccggttttgcggattttcacttctacgatgccttcgtcggcacgttttccgacagtgatgcggatcggaaggccgatcagatcagaatcagcaaacttcacgcctgcgcgttcagcacggtcatcgtataatacctcataaccttccgcctggaatttgccgtaaagctgttcagcaagctctttttgcgcttcgtttttcatattcagtgccaaaatatgaagatcatacggagcaacgcttttcggccagatcaagcctttttcgtcgtgatgctgttcagcgatggctgaaagcgttctggacacgccgattccgtaacatcccatcagcatcggctgcgcacgcccgttttcatcaaggtatgtcgcattcatcgcttcagagtaacgcgtgccgagtttaaagacttgtccgacctcaatcccttcagcgaaacggatcgtgccttttccgtcaggtgacggatcgccttcctgaatgattcgaagatcggcatatgcttttactgacgcgtcacgttcgatgtttacgtttcggtaatgacggtctttttcattcgcgccgctaacggcgtttaccattactttcacggcttggtcggcataaatctcaatgtcgccggcagcgccgatcggccccgcaaatcccggctccgtgccaagtttctctgctacttcttcatgagacgcaagctcaaccacttccgtgttcagaaggtttttcactttcacgtcattgacctcatgatcgcctcttactaacacgagaacaaatcggtcatcagctttaaacagcattgatttgatgcaggcgctcggctcgatctgcaagaacgaagcgagctcttcaatgcttttgacattaggcgtatcaattttctccaatgcctcgggggtttcatctgacggctcgctgttcatgacaacttccgccatttccgtattggctgcgtaagaggatccatcggaataagcgatggtatcttcccctatttcagaaagagccataaattcatgcgtgtcttttccgcccatcgcgcccgagtcggcaataacgggacggacgtttaattcacagcgtgcgaaaatgctgctgtatgcgccgtacatgttttggtatgtttcctccagactttcttcagaagcatggaaagaatacgcatctttcatgatgaattcgcgtccgcgcaataagccgaaacgcgggcgtttttcatctctgaatttagactggatctggtaaagagtgagcggcagacgcttataagatttcacctcatcgcgcacgagagaagtaatgacttcttcatgcgtcgcgcctaaagcaaattcacggccgtggcggtctttcagacgcattaattcaggcccgtacgtataccacctgcctgattcctgccatgtttcagcctgctgaagggccggcatcagcatttccaccgcgttgattttttccatttcttcacgcacgatcttctgaatgttttgaatgaccctgtaagccaggggcatgtagctgtaaaccccgctcgtattttgtctgataaatcccgctctcagcagaagcttatggctttttgcttcagcatcagccggcacttctctcagggtcggaataagcgtcaaactttgtctcatgtcttcgcacctctgattttttactagtcaattataagaataaacgctggatatcgttccatgtgacaaccagcataagaagcattaagaaagctacgccgataaatacgacaaatgcttccttgtcacggtttatcggcttgccgcggattgcttcaatgaataaaaacagcagccgcccgccgtcaagcgccggtatcggcagcaggttgacaattcccaggttgatgcttaaaaacgccgcaaactggaataggttgataataccggtttttgcaacttgatccgtcatatcataaatgccgacaggacccgaaagcatatcaagcttaaactggcctgtcacaagtttgctcagattggtcaggatcgcttttgtgacatcaacggtagatgtcgcgccgtaggcaatcgctgcaagcgcgcctttttcagtcggcgcataagagccgaagcggccgattgtttttttattttcatcttttacagcttcaggtgtaaccgagatatgaaacgatttgccgtcccgtttgacggcgacatcgattttttttccgggattttcttttaccgctgtcacgatgtcggtccatgacctcattttttcaccgttaatgctctggatatagtcgccttcttttaaaccggcagccgctgcgcgtccattgtctgtcagcttcccgagctcaggctgattcgaaggcacgccttgaatgaatccaagcatgacgagaatgacatacgctaagatgaagttcattatcggaccggcagcaatcgccttaatccgcttccatacgggtttagacccgaattgtcgattgtaaggcgcaatctgcacttcttctccgtctacgataaaaaaagaggtctgactgacagtaaagcccgccagttcatcttctttcccctgctcgtacccggtaatcttcatttcgtgctcaagatcagccgtctccacctcgataattaaagcgtcgggatatttttccttttgattaatgatgactttttccacttcgtcatctttattaaaaagaagcccgacggtataaccgggtttgacttcgatcatctccgggtcttcaccggccatgcggacgaacccgccgaccggaaggagtctgatcgtatacacggtttcattctttttaaatgaaaagattttagggccgaagccgatcgcaaattcacggcaaaggattcccgctctttgggcgagcaataaatgcccgagctcatggaaaaaaacgagcgttccgaaaataataataaacgcgataactgtattcacgaacataccaccttatgtgagtattgaattaacgtatccccgggtgtctttgtccacttcttggatatccgcaagactcggatcctgaattacgctgtggcggtccaatgctttttcaatcaggtcctcaatcgataagaatgaaatccgtccggcaagaaaagcggcaacggcttcttcgttggccgcatttaaaaccgtcggcatcgttccccctattttacctgattcaaaggcaaattgtaagcagcggaacctttcaaagtcagctttcgcaaaatggaggcttccgatctcccataattcaagcctttttgtttcaggcagaggcagacggtccggatatgtcagcgcatattgaatcggcaccctcatgtccggatttccgagctgggcgatgacgcttctgtcgtgaaattcaaccatcgaatgaatgatgctctccttatgtaatacaacgtcaatctgttcatacggaatgtcaaacagccaatgcgcctcaatgacttcaagtcctttattcatcattgtagccgagtcaatcgtaatttttgcgcccatcgaccagttcgggtggttaagggcgtcggcaatcgttacagactcaagctcctgccgcgttttatctctgaaactgccgccggatgccgtaatgatcaggcgctcgatatttttgctctgttcgccttgcagggcttgaaaaatagcggaatgttcgctgtcgaccggaagaagaggaacaccgtatcgttttgcgtgtcctttcactatatgcccggcagtgacaagagtttccttatttgcaagcgcaattgtttttttctgttcaatcgctttcaaagtcgggattaaaccgacgcttccaagcagcgcattgaccacgatatccacttcgtccatgactgccgcttcaatcaggccttcttctccgatgccgatttgacattcatgagaaaaagacgcttctttcactttttggtatgtatccatgtcgccgactgctacatatttcggctgaaacgttctgatcaacgggatcgctttctcggcgtttttaccgaaagtcatcgagacgagacggaactgatcttgatgcatgcgcaatacgtctaacgtctgctcccctattgatcctgttgctcctaaaagacaaatattcttcaaaatgccactcccattctatgcgtccagatcggtcttattttcatattagcctttctcatgaaaaaagcgcaagcagaaagtataagaacggcatgacaaacaaaaagctgtcaaatcgatctaaaatgccgccgtgcccgggaaggatttttcccgaatccttcacatcatagtgccgcttaagcgctgattcaaccaaatccccgatctgtccgaatacagacagaacaagcgtgatgaccaaaagaaccgggtatgaaatcggaaggtgcgcaaacagctgaaaaacagccgtaaaaataagggcgatgacaataccgccgagaaacccttccaccgttttgttgggactgatttcgggccacagcttccgcttcccgagcgactttccgacgaaatatgcgcctgagtccgttgaccatatgacaacgcaggcataaaagatatataaaagcccgtttgtttcaatgtttctgatttcaataaaataatgaaaacacagtccgatatataccgtcgcgagaacgataaacccgacttcatcaaacgtaaaggtgtttttcacgagcaccgtatagctgagcagaatcaatacggcgaaaatcgttacttccattttcgcatcgaaaaaatgatatttgtccggcatcatatacagccataacaacaagaggctgatcagacccggaaaagaaaaaaatctgagctttttcatccgcaaaagctcaaaaagcgctatacttcccatcacgtaaacaaatacggtgaacggcaatcctccgaaaataaccaaaaataaaaataatgccgctgccagaacacctgttaacaatctttgtttcatttccaccatcctctaaattccgccaaacctccggccccgctgctgaaattctcccactgcctgcagaaagtgatcttctttaaaatcgggccacaggacatctgtaaaaacaaattcactgtaagccacctgccaaagcataaagttgctcaatctgatttctccgctcgttctgatgagcagctccgggtcctggattgattctgtcattaaatgcccggaaaagagcgcttcatcaatgtcttcgatattcagcgtgccgcttttcacctgttcagccagtgcttttgccgcattgacgatttccgtgcgtccgccgtagttcaaagcgaaattgagaatcagcccgtcattttgttctgtatcttttacggccttctcaatcgccctgtacgtatgagaagggagcgcggattcatctccgataattttcacctgtacattttcctctattaattcaggaagatacgtattcaggaactcttccggaagcttcatcaaaaagtcgacttccatcttcgggcgcttccagttctccgttgaaaacgcataaagagtcagaactttaacgccgagctgacttgcgagctttgtcaccctttttaccactttcattccttcatgatgtcctgcaatccgagggagtgaacgcttcttcgcccagcgtccgtttccgtccataataatggcaatgtgtgcgggaatttcacccttcagtatgtcttcttttgtataccgttctaagttggaagccgcattctgctgattcttccaatttttgagtatgttgagcatgagattcctccgtcacccaaaaaggttgcgttgctgatgatcaatgtaatcaacagtattaacaaaaaaaccccctgtaaacatgagagggtcttttcacattatctattgtacatagtttttcattaaacttccatgatttctttttctttgtccttcgtgacgctgtcaatttttgacacatattcatctgtcagcttttgaacgtcttcactggaagcacgaagctcgtcttctgtgatgtctccgtttttctcaagttttttgaggtcatcgttgctgtcacggcggacattacggactgctactttcgcttcttccgcgtattttttcacgactttgacaagttctttacgtctttcttccgtcagagccgggatcgcgatgcggataattgtgccgtcacttgtcggcgttacgccaagatcagctttcaaaatcgctttttcaatatcaccgattgccgttttgtcatacggtgtgacaacaagcatacgcgcttcaggcacattgatggaagacagctggtttaaaggtgtttgggcaccgtagtattctactgtcactttatccaatagagatgggttggcacgtcctgcgcggactgacgccaattcacgtgaataagcggcaaccgctttttccatgcgttcttttgtttgtgttaatacttcgtttgacaacgttatttcccccttacgatcgttccgattgattcgccgattacggcacgcttaatatttccttcttccataatagaaaagacgatcagcggaatatcattatccatacatagtgaagaagccgtagaatccatgacttccagcccgtcttttaacacatcgagataagataatttttcgtatttaacagctgactcatcttttctcggatcagcattatacacaccgtcgacattatttttcgccattaagatcacgtccgcttcgatttcagcggcacgcagcgctgcggttgtgtccgtagagaaataagggtttcctgttcccgcggcaaaaataacaacgcgttttttctccaggtggcggatggcttttcttctgatgtaaggctcagcgacctgacgcatttcaattgatgtctgcactctggactgaattccgagcgtttccaggctgtcctgcagggcaagtgagttcatgacagtagcaagcatgcccatataatcggccgtcgcacggtccattcctaagtcactgcccgtttttccgcgccataagttgccgccgcctacgactacggccacttcgacgtcaagctcagcgatttcttttacctgtttagcgatggattggatgacagtcggattaatgccgtttccctgctctcctgccaatgcttctccgctaagctttaaaacgatacgattgtattttggtttttccataataacctccaagtgtaaacattgccgtttcctattatgcaagagaaaaaaaggtttgtaaatatagttttaaaaatagggaacacaagtagtgtcccctatactgcctgaaaagccgcgaaagattcgccaaggctttccgccattattttttcacttggttcataacttcttcagcaaagttttcttggcgtttttcaataccttctccaacttcgtagcggacgtaagttttaacagatgcgtttttcgcagccacaacttgtttcactttttcgtctgggtttttaacgaaggcttggtctaataagcaaatttcttcgaagaatttgttcagacggccttcaaccattttagctacgatgttttccggtttgccttcttgaagagcttgctgagtcagaatctgacgctcatggtttgcttcttcttcagacacttggtcgcgggaaatgtaacgaggatttaccgctgcaacatgcatcgcgatgtcttttgcaagatcctcgtcagttgttccgctaagaacggataatacgccgatgcggcctcccatgtgaaggtaagcaccgaacgcttcgctgtcttcttttgaaataacagcaaaacggcgaagagtgattttctctccgattttagcaacgttgcttgtgatgtattcttcaacagtagaaccgttttccatcttttgacccattgcttcttcaagatcagcaggagcgtttgcaagaaggtggtcagcaagcgtgttcagaagctctttgaagccttcgtttttcgcaacgaaatcagtttcagagtttacttctaagataacgcctttgttgccgtcagttttaataagagtagaaccttcagcagcgatacggtcagcttttttagccgctttcgcaattcctttttctctcagaaggtcgattgctttgtccatatctccgtcagtttcagtcaatgcttttttacagtccatcataccagcgcctgttttttgacgcagttcttttacctgctgtgcagtaatagccatttgaattcctccttatatgtgtaaacaagatatgtatagatacatttttcttgaaaaaaggtgataaaaggcagtccctcttatcaccttttgattaggttacgcagttgtcgtttctgtttcaggtgcagtctcttcagcagcttccgcttcttcttcgccttgcttcgcttctaagatagcatctgccattttagaagtaagaagtttgacagcgcggattgcgtcatcgtttgcagggattacgacatcaatttcatcaggatcacagtttgtatctacgattccgatgataggaatgttcaatttgcgagcttccgcaacagcgatgcgctctttgcgaggatcgatgatgaataatgcatcaggaagatccttcatgtctttaattccgccgaggaatttttcaagacgctctaattcttttttcaattgaacaacttcttttttcggaagtacttcaaatgtaccgttttcttgcattttctcgatgtctttcagacgcttaatgcgtttttggattgtttcgaagtttgtcagtgtaccgcccaaccagcgttggttgacatagtacatgccagaacgtacagcttcttctttaacagaatcctgagcttgtttttttgtgccgacgaaaaggatttttccgccttcagcagcaaggtttttcgtgaagttgtaagcttcctctacttttttcactgttttttgaaggtcaatgatgtagattccgttacgctccgtgaaaatgtaacgcttcatttttgggttccagcggcgtgtttggtggccgaagtgaacaccagcttcaagcaattgtttcatagaaataactgacatgtgatttcctcctaataaaatggtttttttcctccgcttaggtcatttttgtgcagaactgccgtttgcagcaccctctgcataaatcgttaagcgtgtgtatttaacaccaagacataatataacacagctttatgcgacaatcaagaatcctttacagctttgccgcgaaattttaaaaacagctcgatttctgtctttccgctctgcatccgtttggcgatttccgcgggggtgagcccttgttcatataattctgaaacacgttcttcaaacgaatgcgcgcccctgttttcgtcactttcaacccgttccgttgcactgataagcttttccatgtggtccggaatatcaggctcttctttcggttccggccggggttcggcgtcttctgcgtccggcgcttgacggctttttgcgtcttcgagtctttcattttcttctttcagctcaagcagaaacgctgcaagggtgttttccgtctcttcaagaatcttcttctgctggcgctccgtctccttgagggctgaaaacctcgtgtacagaataatgacggcataaagcagtacgccgtgaagcacaaagcttaaaagccataatagtgttgacatgtttttcactcgctaaccatgagttcattattgaattactttttcaagcagatgctttaatttaaacagcgcctttgaatgaatctgtgaaatccgcgacgtcgaaaggttcaagacttgtccgatctcggtcaaagtcagttcttctttatagaataaactgacgacaagctgctctttttcagagagctcgtgaattttgcccgcaagctgagcgatcagctcgtccttcatgattttttcttccggcggcacatttttgtcatctctgatcatcacttgaatattctcaccgtcatcctggtcgtgaagcttttcatcaattgataagagattggcaaaaaacccttcattcatcgttgatactacgtcctgctccgtcatccccagctcttctgcgatctctgaaggagtcacattccgaaggtagcgctgttcaagtttttcgatcgccgcttcgactttttttgtcttctcccgtgaagttctgggcagccaatcttctttacgcagcccgtcaatgattgcaccgcgaattctaaacgaggcataggtatcaaattttaaatcccggccggggtcaaatttttccagggcatcatataaaccaagcataccaaggctcattagatcgtctttatgcaccgatttcggcagtccgacggaaattctgccgacatgatatgtgaccagcggcatgtaacggcgcattaaatcatcaccggctttaggatctttccactctttccagcgcgaccaaagcacctgatcttcataattcaaggattgcattgttatccccctacctcatacctttattaaatcgttgtttcaccttgtttaacagttcgaatgtgcagcatgcaggactttggctcaaattcaatcgtccggccgcttgagccgcccgtatcttcactgatgaccggaatgttatacaatgaaagctgctctttgatggccgctacattcctcggaccgattttcatcaggtcgtttgtcattttaaacttaaacatctccgctcccccggcgagttttgccttcagggcaaacttgcggcagccggctttcaaaagcatatcaatcgtcatcttaacggcggtgtccgcgtattttgcacggttgagctccgccgtttttgataaaccggagtccggcagcatgacgtgaacgagtcctgccgtttgtttgtctttatcgtataaaaccagccctacgcatgaaccgagtcccgaggtccggattttatccgggtaacgcgcgacttgaacatccgcaatccccactttaacgactgcggcttccgcacggctcataaagccgcacccaatgagacgaagagcttttcaaaagaatcatagtccgggagcataaacatgtgggctttgagctcttgccggctgccctggtcaaaaatagaagtatccacgacaatggcatgctctccgacttggctgagttccatcagcccttcactgataaccgcgccgaacatatcaagtgagatttccggcacgctcgggtaaatctcaagctttgtcaaatcagccaatgccgttaaataggaacctgctaaaatattgccgaactcatgtaaagcagaagaactcaaatgatcttcacccaactggtcaatatcaaaatccggatttccgatcagctctctgataaactgttccgcctgatggaaaggcatgatgagaaagatagagccggtcatgtcgccttccattcttaaaaagatactggcgaccggcgtttcagccccgccgaaaaaatcagcgagctcatcaaatgtcaataaagtcgcaaacggcacttccatgtctatctttctgttcagcagctgagccattgcagaagccgagtgacccgccccgatatttccgacttcccgcaaaatatccatctgctcttctttgatcgcttcaaacttactcatgttgtcttttcccctttaagcattaggctctccggacgcagatgccgaagcacctttatccagcaccgcatgcgcatcgataatattgaggagcctgttatcttgcttgacgatctgtttaatccacacatccgtttcctttgtctggctttcaggcgcggattcgatttcattttcatgcacggtgatgacgtcattggcctcatccacgacccatccgacatcagcgtcacggtaagaaatgatgataatccgagtctcttctgtgatgtcctgttcaggctgattcagacgttttcttaaatcaagaaccggggtaatcactccgcgcagattgataacgccgcggatataagattccacacccgggaccctcgtcggtttttgccacttttcaattgatttcacctgggaaactgagatagcgtattctttcccgtttatcataaacacaatcattttttcacctgttttgatttcagcagtcattcgggcacctcctcgtgtcgttttagtagatcagcgcattgcaatcaataatcagcgccacttctccgtttccgagaatcgtagcgccggaaatcgcaaagacgttcgtcaaatagtcgccgagtgatttcagtacgacttcctgctgtccgataaaagaatccacgacaaaagcagtggatttatcgccctttttcacgacgattacatggaactgatcggcatcctgttttgaatccgtaatgccgaattcttttttcagatagacgatcggaacgatttggcctctgaaatcaatcacttctctgtcatgcgtctgcaggatatctttcttatcaataacagccgtctctataatagaagaaatcggtatcgcaaacgtctcttcttccagtttaatgagaagaacggatataattgaaagtgtcagcggaagctggatactgaaaagagaaccttggccttccgcggatttgacactgacagagccgccgagtgattcgagtttattttttacgacatccaggccgacgccccgccctgaaatgtcagaaatttgatcggcagtcgagaagcccggagcaaaaataagctcgtaaatctcattatcttcaagcgtttcagcatcacgttcggtgattacactccgctcgagcgctttttcaagaattttctttctgttcaggccggccccgtcatcttcaacctcaataaagacgtggttgccgctgtgatatgccttaagcacgacatgacctgattccggttttcctttattcacccgcacttcaggcgattcaatgccgtgatcgatgctgtttctgattaaatgaacaagcggatcgccgatttcatcaatcaccgtgcggtccagctccgtttcagctccgatgatggacaattcgattttcttgtttaattccttttgaagctggcggatcattctcgggaaacggttaaagacggtttctaccggcaccatccgcatattaagaataatagactgaaggtcgcccgagattctggtcaggcgttcaacggtttcagtcagctcattgtggtcaagctctttggcgatctgctcaagacgtccgcggtcaatgacaagttcttcaaaaaggttcattgaagaatccagtctttcaatgttgacgcgaatcgttttcgagccgctgtgatgcttcggctgttcttccgttttcgcttgcggcttaggctgtttctcagcctttttaaccggagcttccttcaccggttcagccgcttgcggtttttcggccgtttttaacggcgcaccggcagaaatttcgacattctccacttctgaaatgccgctgatgagttctttaatttcttcagcaggctgctttgtcaagaaacacacctgaaaatccgttccgaaatcttccgtctcaagcacttccgcggcgggtatcgtttttgcgacttccccggcttcattcagcttttcaaatatcatgtacacgcgcacggctttgagcatgcagctttcattcagggaaaccgttatttcatagcggctgaatccttgctcttccgcctcttcaataacagtccgttcgaactcgtcataatcccattcagttgaagcctgttgttttgaagccggcggttctgctgtttcggctgaagccgcagtctcatgcaccgcatttacgtcgagcttcgcactcacttcagaaatatcacgtttgccgtctcctccgtcaataatggactgcaccatctcttcaagatgatcaagcgcttcaaacagcacatccagccaatctgatgtaacgggcatttctccgttgcggatggcgtccagcacattttccatcaggtgggttaaatgcgccagatctgtataccccatcgttgcgctcatgcctttcagcgtatgggcagctctgaagatgtcatgcacaagctgaaggtctgccggatctttttccaacagcagcagcttttcgttacatgtctgtaagtgctctttactttcatcaataaagacatctaaatattgattcatatccaattgattcacaccctctcttttttcacacatccggtaatggatgccgcgatatcttccacatgtttaatctcatgaatgaggcccgcctttatcgctgacttcggcattccgaacacaacacaggattcgtccgattccgcaatcgttttaacgctgcctgttctaagcatttcttttacgccctcggttccgtcgctgcccatgcctgtcataatgacggctaccttttcgtaatcggataagcggcttgccgaccgaaacaaataatcggctgacggtttatgccggctttccgtatcatgaacgtcaagaatgatgcggagccttccgccttcctctgcaaccgtcatattttttccgccgggcgcgatgtacacccatccgtctttcgcttcttcaccgttttccgcttctttgacctgaatatctgacaaatggttgagtctgtctgcaagtgaagcggtgaagccttcaggcatgtgctgaacgacaaatacaggcgcctttaaatccttcggcagtttcggaatcaccttttgcagagcccgcggtccgcctgtagaggtcgcgatgaatacggcctgcttggcggatcttactttcggtctttcaaatcccgccaaagccggacgttccgggatagaagactctttcactgccgcctcaggtttttgtgcgcgggacagcccggctgcaatcaccctctcaatcagctgctctttaattttataaagatcaagtgaaattgctccggaaggcttggtgataaaatcaaaagcgcccatttccaggcagttgatcgttcggtccttcccttgctgtgtctggctcgataccatgatgacgggaagtttatatatgctgatgatcttccgcaatgtatccgttccgttcatgaccggcatttcaatatcaagcgtgacaacatccggtttgagaagctctattttcttcagcgcctcttccccgtttctggctgtcccgatgacttctatctgcacttccgcagccagaaaatcggtaatcatctttctcataaaagctgagtcatcaacgacaagcacacgaatcactgtaaagtcctcctcaataaaaaagaagataatctctcaataaatgccggtttctcttctcttggtttgttttcttccgtttgaaacaagacatccgtcagaagacggacggacctgctggcttttgcttgaggactttttattaaaaaaggcacctggtcaatgacggcttgacttactaacgggtcatcgggtatggagccggcgaaacgcacctccgcgcctaaaaacatgtgaatcgcatgagaaaggcggttgtacgtgtccagcgcctgtttttgggcgcgggcgcgattgacggcaatgtttacggtcagccgttcatccgcgagcaagagatgtttgatcgcgctgtaggcatccataatggccgtcggctcaggcgttgtcacggcgagaatgtcttccgccgataaaataaacggcagctgttcttttgaaagtcccgctcccatatcaaacagaacgtaatcaaaatcgcttaatacagcggaaagaccattcataaaagccgaccacttctctccgtctgcttgatagatcgcctcaagccccgttcctccggatatgtagcgaaggcctttcggaccggaggacagtgattgcgccaatgcgtgccgattctccatcacatcaataatggtgcgggaagaagcagcgccgatcagcacatcaatgttgcccattccgatgtcaagatcaatgatgagtgctttttttcctttttcctgcagggcaactgccatgtttaatgttaaattagattttccgacgccgcctttaccgctgatgacggctaatgtcttcgcttttttctcataaagctccggcttgatcatttgccgctctctcattttccttcttaatgactctgcctgatcgggtttcatgtcaaaagcatccttacaaactcttttggtgaagccgataggatgtcttcaggcacatcctgtccatttgtcaaataggcggcgccgattcttgattccgacagcacttgaaacacggagccgagtgaggcggtttcatccgttttcgtgaaaatgaattgattgaccggcacacctgaaaactgtttcagcacctgtttcatatcttcatattttgcagatgcggataatacgagaaaggattgtaagcctgattcaaacggaatcatctcttgtaattccgtaatatactgctcttctttaaagtttctaccggctgtatcaatgaaaacatggtcatattcagcgaatttttccagtgccttcagacattcttcctttgaatagcatacttcaagaggagcctgaagcagctccgcatatgtcttcagctgctcgaccgcggcaatccggtaagtatccgtcgtcataaaggcaatttttttatgctctgtcagcattgatgaggccgcgagtttcgcaagtgtagtcgttttgccggccccggttgaaccgaaaagcacgacgtattttgattgaatcccttcctgccacctgtctgccgaagggagctttttcactaacaaatcctgcagttttgagctgacattatcttcagttaaatctccggaaacaattgaagaacggagcaattcactgagtacggcgttttgcgtatgatcaggaagcccggcttgcttcaatagtctctcggctttttttaatggttcagggagcacttctttaaaatgcgccagttcgccggaaatactttgatccggaagacgcggcggctgaacaggctcagctttctccgccgttttggtctttttcatttcttcagcggcagccggcggcgtttttctcgcttccctgacgtcacgatctaaaaccgctatcacttcgacggcctgctgcgaccgcagccccagccattttcttttctttacttgtttggaatgtaaaataacggcatcattgccgagttcctttttgatttgcttcgcggcatcctgcattgaagcggctgtaaatttttttattttcattaaatatccaccactccaatgctctgtacttcaacatttgcttccagctcattataagaaagaaccggaagatcagggaaataccgttctaacagctgttttacatacattctgacagcaggcgagcaaagaagaatcgccgactcctggcggatggaaagctgctcggcctctttagcgacagaacggatgatgctgtctgaaacctcagggtcgagtgacaggtaattgccctgttcagtctgctgtaccccgtctgcaatcgctttttccacccggcctgagcatgtgatgaccttcagcgtttcatgctctctcgcatattgtgccgtgatttgtttggcaagcgactgtctagcgtattctgtcaaaaggtctgaatctgtcgttaatcttccgtaatcggcaagagtttcaaaaatggtcaccaagtttctgattgaaactttttctctcagcaatttggcaagcaccttttgaatatcgccgacagaaagagggtttggcgtgacttcctcaacaagcacaggataattttccttcagatgatcgatcagctgcttggtttcctgtctgccgaccagttcatgggcgtgctgcttaattttttctgtaatatgcgtagatacgactgatgccggatcaacaactgtataccccagcatgtccgcttcatcttttgcagcttcgctgatccattttgcgggaagtccgaacgacggttcaatcgtttcaattccttcaatgacgtcatcttcaggcgtcggtgacatcgctaagtaatgatccagcaggagctctcctttagcgacttcattgcctttaattttcaatctgtattcattcggctggagcgcgatgttatctctgatgcgcacaaccggaatgacaagtcccaattcaagcgcaagctgacgtctgatcatgacgatgcggtcaagaagatcaccgccctgccccgcgtctgcaagcggcacgagtccgtatccgaactcaaattcaatcggatcaatatgtaaaagctgcacaacgctttccgggcttttcagttcatccgcctgagcctcttcttcaagaatttcttcctcttcttcgctcggcttatccgctttggacagcatgtaagcgccgaatgcaagcagaccggcgatcggccccgtcagcagaatgccgatcggtgtaagaagaccgagcaaaagtacagttcccgcggctacatacaagagcttcggataagcaaacagctggcctgtaatatcatgaccgaggtttccttcagatgccgctctcgtcacgacgatccccgtagccgttgaaatgagcaaggccggcatttgagaaacgataccgtcaccgaccgtcagcattgtaaagtgagacgcagcttcttgtatgctcatcccctgctgcagcatgccgattacgattccgaaaataatattgatcatcacgatgatgatacccgcgatggcatcccctttgacgaatttgctcgcaccgtccatggcgccgtaaaaatccgcttcccgggcgactttttcacgtctgtgctttgcatcctgctccgtaatcatgccggcatttaaatccgcgtcaatactcatttgctttccgggcatcgcatcgagcgtaaatctcgccgccacttccgatacccgctcggcgccttttgtaatgacgataaactgaataataatcaagataatgaagacaacaagccctaccagcacatttccgccgacaacgaaattcccgaatgtctcaacaacctttcccccttctccgtgagaaagaatcgaacgtgtcgtcgacacattgagcgaaagccgaaacagcgtcaataacagcagcaatgacgggaatatcgagaattgcagcggttcttgcatattcattgtggtgagaagcacgatcaacgcaagagagatattaatgatgatcaaaatacttaacaaccatggagggaatggaatcaccagcattgccacaatgaggacaacacttattaaaaccgataaatctcttgttgacatgctgtttttctctccttttgaatctgaaattcactatactttttgtttcgttttatatacataagccaaaatttccgcaatgactttgaaaaactcttccggcacggcctggtcaatgtcaacctgatcatataacgcacgcgcgagcggcctgttttcaatcgtcatgacatcgtgttctttggcgatctgcctgatttttaatgcgagatggtcgacccctttggcaacaatgtaaggagcgtccattttcttttcatcatattttaaagctatcgcataatgggtcgggttggtaatgatgacatccgctttcggtacttcctgcatcatccgcctcatcgccatttcccgctgcttctgcttaatcttggacttgataatcggatcaccctccgattttttgtattcatcttttatatcctgttttgacattctgatatttttctcataatcaaaacgctgatataagtaatcaagcccggccagcagcattaaagcccctgatcccgcaagccccatccaaagagtgagcttggaaacgaaagtgagcacttccgcaggagtcaaaagcggaaggcggagaatatcgccataatgcagccagagcaccataaaggcggcaaaaccgaccacagtaatcttcaaaatggatttgaccagttcaacaatcgccctcatgctgtaaatccgcttaaatcctttcagcgggctgagcttattcaagtcaggcttgaggacttccgcagaaaacagaaaacccacctgcatgtaattgctcacgacacccgccacaagcgcgaccagcataatcggcgcgagaatgaggctgatatctttcaccgtatccacgaacagttcatgcacggcagatgctgacagatgtaaagatatcgatttcgtataaaacgttttaataaaggacagcagcctgtcccgcatataaggaccgagcgcgatcagcgaaagaaagataatcagtaaagaaacggctgtattcacatccgtacttttcgcgacctgtcctttctttcttgtatccttccgttttttcggcgtggctttctccgttttttcaccggcaaagaattgcagattcagtctgagcctcatcatgtcacaccgaccaatgccaatagattccgcatggtttcaacggtaaggctgaagatgttgcggacaacgacaaacatcaccgccatacaaacgatcagcataataaagctcacggctattttcagaggaagcccgacaacgaaaacattcagctgcggcaccgttctcgccacgataccgagcgccaaatcaactaaaaacagactggccacaaccggcgcagacatttgaaaagcaataataaacatggcattgaagctttttgcgataaaaagtccaaagtgatcatttccaaacgacggaaatgcctgatcaagcgggatatactgaaagctgtaataaatcccgtccaataaaagataatgggcgtttatgctgagcataaataacagcgccagcgtataaacgaattgtccgatcagcgggctttgcgttcctgattgcggatcaatgacattggcgatggaaaagcccatctgaaaatcaataaaggaacctgctatctgaatggctgtcatcatcatgaaagcgatcagcccgaggctcaagcccacaacggcctcttttatgacaagcagcatatactgttcccctatttctatttccggcgcatgtttcagcgtgctgaagcagatcaccgaaagaaaaaaagcaaagccgattcggtgaaccgccggcagattccgatgtccgaacaccggcaccgttacaaaaaaagcagagattctgataaagaccaataaaaaagcgggaaataaatcaatgatggaattcatttgattctaccctgcaaatcggttcagatgagaaaacagatcagttgtgaacgaaagaatcgtcgacagcatccaaggaccgaaaaagatcagtccaagcatcaccgccacgattttcggaatgaacgcaagcgtctgttcctggatttgagttgtcgcttgaaagatactgacgagcaaaccgacaatcagcgcgatcgcaagcagcggcccgctgatcattagtgttacatatacggctttttccgccatggaaattacaaattctgaactcacaattagcacctaccctaaaagctgtcaagcaaagatttcacgattaaataccatccatcgaccaaaacgaaaagcaatattttaaagggcagagagatcataaccggcggtagcatcatcattcccattgacattaagacgctcgccacgaccatatcgataattaaaaacggaataaaaatcataaagcccatttgaaaagcggttttgagttctgatatcgcataagcgggcaccatcgtcgtcaaaggaatatcctgaatcgattcaggttttttcattttggcatagttcataaacagcgccagatccttctgccttgtatgcttgctcatatactctttaatcggcttctcggcttttgtatatgcttcatcgagactgattttattgtccatcagcggcgttaaggcttccttattaatctctgaaaaagtcggcgccataataaaaaacgtcaaaaacagcgcaaggccgattaaaacctggttgggaggcatgttctgcgtcgccagtgaggttcttacaaaagacaggacgatgacgattctcgtaaagcaggtcatcaaaatcagaatccccggcgctactgaaaagacagtcaaaagcagcagtaatttaacagtggagctgacttcggtcggactgcttgaattaaaaagattaataaattcattcatgatgataagggcctttcttctttccttcagaacggctttgtttcagctcgttcagctgttctttcagcgcttttgaaaacgacggaagcatcgtttgcggctttttttctccatccttacgccgatttacgagcttggtccattccacttttgaagacatcgactcttcgtattggctcagaatcgcctcgcgctctttttcatcttcaatttcttttaaaagctgtatcgtttcgcccacaccgactacgagaacactgtttcccactttaatcagctgcacggaacggttttggccgactgacgttccgccgatattttctacatattgaaacggcttcagcagacggtttcttctattcatcagtttgacaaatccatagatcagcagaatgacgaataataacgccccaatcatctttacaaaatcaaaagcggagacagaagatgcagaagcatcccctatctcttgatcagccgtttgtttcgatgtatcgctttttttctctgttttgtttgttgattgtttgtcaaaccattcgttgacggtggaattgtcagactccgccgcaaaagcagggaacggatgtacattgagtaaaacgaaacaacaaatcaaagctagtaaaccatgactctttttcaacagtcgtacaccctttagcttaatgttttattaatagcttcaagcacgcggtccgcttggaacggtttcacgataaagtcttttgcaccggcttgaatcgcgtcaataaccattgactgctggcccatagccgaacacatgatgattttcgcctgcggatcgatttgtttaatttcctttaaagctgtaatcccgtccatttcaggcattgtaatatccattgtcacaaggtcgggggaatgctctttgaatttttcgactgcctgcgctccgtctgaagcttcagctacaacgtcaaaaccgttcttcactaaaatatccttgatcatcattctcataaatgctgcatcgtctacaattaaaattctgtgtgccataatctgtttctctcctctatgttcgcttattttaaattgttaaggcggtctgcctgacttaaaatatcagtgactctcacgccgaagttttcttctatgacaacgacctcgccctttgctacgatccgctggttgaccaggatgtcaacaggttcaccagccagcttgtcaagctcaataatgcttcccgcagaaagttcaaggatttctttgacgcttctcttcgttctgccgagctcaaccgtaacggaaagcggaatatccatcagcatatcaaggttattccttgatccttgcgccgcttcgttatgatcaaatgcctggaattctaccggagcgacttgaacaggagcagctttttttgcggttccctgtctcttcggaagctcgggttttgcctgcggctccggctgcatggcaggttccggctgcggcgtttcgtatgtttcctgtggttctgatacggtttctgcggcctctgactcatgctggtctgcagtcatcaggtctgcgatcagatctttcgcaaacgtaatcggataaagctgcatgatgctcgaatcgattaattcgccgactttcagacggaatgacacttttacgagcaggtcatcctcaggtattctgtcggtccctttttcttccgtcacatccagaagttcaacccttggcggagaaatgtcaatctttttactgaacacggtcgacattgacgtagcagccgagcccatcatttgattcattgcttcctgcacggcgctcaggtggatttcaccgagtgacggatcggcgccccggccgtccccgccgatcatcaaatccgcgatgatggccgcgtcgctttgttcgacgacgagcaaattgctgccgtcaaagccttctgtgtagttcacttcaatggcaacatacggatgaggaaattcatcactgattttgctttttgaaatgacggtcacactcggcgtcgtaatgtccactttttgatttaaaagagtggacagcgccgtagccgagctgccgaacgaaatattcccgatttctccgatcgcatcgcgctcaagttcagacaagttcgccccttgaggctgttctgtatcctctgactgactgcttgtgccgttaagaagagcatcgatttcatcttgagataatctattgttcatcttgttcacctcttatgtcgtgatctaaaatttgcactgcctgtcttcgattcacccggccggcctgccctaaaaacttcggtttgtttccgaccaatacagtaagaggatcagtcactgatttgtccagagttatacagtccccgacttccaaacttaaaaattcttctattgtcagttcagaagcgcccaagagagccacaacgggaatttgagccgtcatgatgcgcttttcaagcaacttcgtttcttcgggcttcgcttcattccggtctgattgcatccaataatgtacggaaagcttagggataatcggctcaagtacgacatggggaatacaaagattaatgacaccgctgatttcacctatctgcgtattgagagaaatgacaacgactgtttcatttggggaaaccatctgtacaaactgaggattcacttcaaattcagtcatttcagggtcaatatcagcaatcgattgccacgcttctttgtagttgcccagtgcattttcaaataagttagaaataatattcgtttcaatttccgtaaggctgtcagctttgttatgagtgatgccgatgcctcccatgacgcggtcaagcattgcgtatgcgatggtgggattaacctccatcatgattctgccttccatcggatgaacatcgaataaatttaaaatcgtcatgttcggtatggaacggataaattcttcatacggcacctggtcaactgagctgacggatatatgaatatacgttctgagcttggcggaaaagtgtgttgtgagaagcctcgcaaagttatcatgtatccgggttaaactgcgtatctgatctttcgagaatctgagagcccgtttaaaatcatatacctttacttttttctctttaacttcctttttcagctcttccgcatccgcctcacccgtggaaatggcggaaagcagtgcgtctatttcattttgggagagaacttctcctgacattttcttcacctccgtattctgtcaaatttgtttttattgcagattaaaggaggtaatgtacactttctgaacttttccttcttggagatagctgtttactttctcttttaatgattgtttaaacgcttctcttcctttatctccctcaatctctccggcgcttgtgccggctaaaatggaaatgatgttgtctttcacctgaaaatcgcgtttttcaagttcttccttcgctttagccgagtcggtttcaagcttgatgccgatacggatgatgctgtcagactttaagtttgtcgtaatatcgtcgacagacacagtggctgcaacgacttcgtcaattgtcggctttttatctttgccggaatttccgctgacgacaaaatatgctgccgttccgaggccggcgatgacaattaaaataatcagcaaaatgatgactaattttttcttcattcttcttcctctattccctgatccagtgaaaatatttgtatactatggtaaaacgatatgacttttttgagaactgcttcttccggttctttcactacgaactttttgccgttggacagtgtaatcgtcgtgtcggggaagcactcaatctgttcgataaacagcgcgttcagcgtaaaaggctggccgtttaaacgggtgacttgaatcatgcaatccggagaagcggcctaaccgcctctcctccctccttaccgtttcagattaaccagctcctgaaggatttcatctgaagtcgtaatgatttttgagtttgattggaaaccgcgctgagcaacgatcatttcggtaaattcatctgtcagatctacgtttgacatttcaagatagcctgccaaaagcttacctgttccgttttcgcccggagtggtgactgcgcttgcagctcctgaacttaatgattctctgtaaaagttgcctccgattttttccagaccggcgctgttagggaacgtgaccagaccgatttgtccggcatcatgaacctcatcccctgcatcagtgtatgtaacggttccgtctgcaccgatgctgtaatctttcgcatcagtcggaatattgattttgccgccgccgattttttcaagatagtatccgtcagtcgtaacaaggttcccttgattgtcctttccgaaattccccgcacgtgtgtaaacaattcccgcacctgtattaatctgaaagtagccgtctccgtcaatggctaggtcggttttattctgtgtagcctgcggggcgccggttgaatgaacaacatcaatggaagaagtcgcggcacccaagccgatttgttttgaattggtcacgtttgaaccgccggcgactgtctggctgatcatatctttaaatgtaacgcggcttttcttaaatcccactgtgttgacgttggcgatgttattgccgattacatctagttttgtctgaaagtttttcatgccgctgataccggaatataatgaacgtaacatgttaaattccccctgagtttcttattatttagatgtttcgctgacggccgtgacattccacggactgacctctttgccattttcaagcacgagcacgtaattgccgtttgaatgcttgactgaattgactgggcttgtctgatccttcccgtcgctgtcgctgaatgtgacatttttgccgatccagttcacatacatcgtaaacggatcttgattttctacaaatttagtcatcgtcgtattcatattcatcatttgctccaatgaagaaaatgtcgccatctggctgataaattctttgtcatcaaccggattgagcgggtcctggttttgaacctgtgtcattaagatcttcagaaattcgtctttccctaaattcgtgctgctgtttactgcggcggtgctcttcgcgcttgaagtggttgaagcgcccgccgcggcataatccgagtttactgatgtcaactattcttcctccatttcattgagagaaagctcctccagcatatctccgaaatcgcctgactgctgctggttcttctgctctctctgtccctgatgctgctgtttattgtgatcggccgtctgcccgtaaacaggctgctgatccccgctttgaagcgggactgtaaaacggtcgacctggaccgacatattcggaagcgactgtttcagctgaggaagatgctgttccagcagctctttcgcggactggctggatgcgattattttgctttgaaacatcccgttttcgtttgtcaccttaattgtgacaaatccgaggttctcgggattaagacgaatcgtaaagcttccggttgttttcccgaaaggcgtgtatttcatctgtttccagccgctgatgacctgatccgttaacggtttattttctgccggctgctgttcagctcctgcggacgtttgctgaatgccggcaaggcttctcgttcccgaaaacagtatatgtgcagacaatttgctgtcaggcgcctttgcgtgagaaaccgtgccgccgttttgctgttctgtttttccggctgactcttgggatgattcagatgattgagataacacaaaagctttcagctcagtttcagccatatcccattcctttgttcccttttgagaaaggcccgcaagctgctccgcgacgctttgaaagctcttcagctcagcggctgtcatggagtaaagtttagatgcagattcgtttttcggaaaaaatgtctgccgcaggtcttgaatcacgcggtctgggacaccttgttttttcaatgcctctaataaacgggcgccttcctggtaaaccgcctttgcctgcgcgctgtcaggcagttcctgctgagatgtgaagagctgggatacggcttcttgaatgaaaagcagacccttctcaagcgcatccttgacggaatccccgtcttttgcgaaagaatccggctcatccgtttcaggcttcgccccatgctttttccccgctaacatgtcttcaacagattcggcaagctgtttcaataaaggaagagctgtttcagccgtctgctttccttcaagagcttttaccgcctcaagcagctgttttagctgcaattctttatcttccgggccggctttcagccaatcaccgattttcgatagggcatcattcagctcagcgtcacttgttttggtttcatctccgggctgccggggagaagtgatttccgacaggagccagttctgaaatagacctaagctgtttacattcatcttcacattgctgttttgtgcagcctgcgtacgattacccgttaattcaagcagcttcaacttacatcactccttatttccgtcagcggatagtttttctgtatatttagccgcttgttcaggagtcattttcgtcaagatttcagcaagctgctttttacttaatccgtttaaaatatcgagggcttctttttctttcagctttacgataatgcttgccgctttaccgctgtccatacttttatagatgttgatcattttatcttttccggctgaatccgcagcgtcttttttcgtttcatccgtcttcgttttctgctgctgttcagcttcctgtttcagtgaacggattttctgattcagattatcgatttcggacttgcttgtgtctaaatctttattcaaaatgttaatttcacttttttgttcctttatggtcttttcaagagaagccgttctgtcttccttctgcttttcccccgcgcttttcatttctttcgtttcgggaaccaattcttttaaaacaggcgttttagcggctgtttcctgaatcggcttcatcacatcaacgccggcagcccaaaggatgatgcttgcgacgatgatcagaaaaatcagcgggatcatgataaaaagcaggattgaaccgaactttccagatctcttttctttatcggccatttcattcgctcctaatgcccctgaatcataaactgcttgattgaaatgtcgtccatttccctcatctctgcagctttgtcttcaagtgcgaacatattaaattgtttttcccgcattttttcaaatttctttacttcaatgtttttttcggtgagctgttcctgcttctcattcatttcatttcgtttcatgatgacaagcttttgataatgatagatggtgttctcaagattggaaacgaattgctgataatgtctcatttcctgaacgctcatcccgcatttaagctttgattctttgtctttttcgagcaattcttttttgctcatattttcatatagtttttcagccactgtctcaaattcagaaaccgattgtctgtattcagtcaatgtttggtctttttcattttcttttaattccagcagcttttgaaatctgaattggtatgccacgatgtttattcctcttttcctgtcagactcgtcaatgccgcaatgctgtcttccaattgagcaggttcttccgttccttgttttaaaaattgaataagctgcggataaaactgaatcgcttcatcaatttctcttgatgatcctcttttgtaagctccgatattaatgagatcttcagagttttgataagttgacagaagatcgcggaatttgttggccgcctctatatgcgctgtgtctgaaatattagacatgaccctgctgatgcttttcaggatgttcacggccgggaactgccctttgttggcaagcgcccgatcgagaacgatatgcccgtctaatattccgcgcaccgtatcggcaatcggttcgttcatgtcatctccgtctacgagaaccgtataaaaagcggttatcgttccttgttcattcgcgcccgttctttccagcaaacggggcaaaatagcgaacacagaaggtgtatatccttttgttgtcggcggttctcccgctgccaggccgatttcccgctgagccatcgcgaccctcgtgacagagtccatcatgaacatcacattccggcctttatcgcggaagtactctgcaatggcggtggccgtatacgccgcttttaaacgcattaaggcaggctgatcagaggtcgcgactacgactatcgagcgtttcaggccttcttcacctaaatccttctcgatgaattcacgcacctcgcgcccccgttccccgacgagtgcgataatgtttaaatcagcttcagtctgcttcgcgatcattcccatcagggtgctttttccgactccgcttccggcaaaaatcccgattctctgcccttttcctaccgtcagcagactgtcaatcgatctgacgccgacacccatcttttcccgtatcggcgggcgtttcatcgggtttggcggcggctgttccgtcgaaacgggggacaaacctttcggaagcgcccggccgtcaagaggttcgccgaacgcgtcgacaacttgtccgattaaacccgcgcctactttgatgcggagcgactcgccagtggcctccacaatgctgcccggcgcgatgctggccgcttccagataaggcattaacagaatgttttcatcttggaagcctacaacctcagctttaatcgcttttctcgcatggcctttcggataaatgagacaaacatctccgattgagctttcgggcccttttgattcaatcatcagcccgatgacccgtttaaccttgccgtagcgcttgtacggatccgctatttcaattgagtctattaaatactgtgtcttcattgctccgctcccgcctcaagcgccgttaaaagtttttgctttaattgcatcagctgggtgtctatgcctgcatcaacacgtccgaacggagtttctatcgagcacgttcccttcgcggctttttcatcggcatataagcttaatctgcattctttgtataacagctgctgaatttcgtccatatgctgatgaaccgtctcataatattcagggtccacatagatggagatgtcatcataatcttttacttcggctactacctgtttgaccagcagaaggaaagcctctttatcatcacttttttgccgccatacttttttagcgagcgcaacggaaagctcaatgatttcttcctcagcgctttccagtttttcctcgactgactgtctcgccatttccataacggcattggcccggctgatgagattagcgtattcagcttgagcctcggcttttcccaatgccatgccttcttcatatccttctgcctttgcttcttctatcaatctttgtttttcttccgcccagcggtttttctcttcttcaatctgcagaagagtgtgctctaattgatttttcgcttcttcagacaccctgtcggcttcggccttggcaaaggccatgagagcctccggattttcgggttcctcccggtctggatgggaatgtgatttcctgacttcctgcaaggaaagcttgcgccgtttttgttcaggagaaaatggtgattgctgtttaatgatattagacaataatatcgtctcctccgcctcgcgcgattacaatttctccggcttcttccagcttgcggacgacgcccacgattcttgattgcgcctcttctacatcacgcaaacgcacaggccccataatttccatttcctctttaaacgtttcaaccatacgctgtgacatattgctgaagacgatctctttgacttcctcgctcgcaaccttcaatgaaagcaggaggtcgtcgttttcaacatctctgatcacgcgctgaatcgcacggttatcaagggtgacaatatcttcaaagacaaacatccgttttttgatttcatccgccaattcaggatcttggatttccaatgaatcaaggatcgttttttccgttcctctgtctacgccgtttaacacttcaacaacggcttctatgccgccggtctgcgtataatcctgcgtaaaggaggaggacagcttttgttcaaggacccgctccacttcatttatgatttcaggagacgttctgtccataaccgcaatccttcttgccacctcagcctgaacgtccgggttcagctcagacaaaatctgtccggcctgcaccgggtcaaggtaggataaaatcagcgccatcgtttgcggatgttcctgctgaatgaaatttaaaatctgttcgggctccgcttttctcgcgaaatcaaacggctttacctgcaaagaagaggtgagcctgtttaaaatgcttaccgctttgtcttctccgagcgctttttcaagcacttggcgggcgtaatttaaaccgccttgtgaaatatagtcctgagcgattgcgatattatgaaattcttcaatgatttcatcttttctttgatgatcgacgcttctgacccccgaaatctcgagtgtcaatctttcaatttcttcttcagacaaatgcttgtacacagaagctgatacatcaaggcctaaggaaatcatgaggatggctgctttttgttttcctgtaagcttgttctgatcacgtttcgccattttccactccccctaatcctcgtccagccagcttcgaagcaatttagcaaagtcttccggtttttctttagccattttttcaagctgttttcgtctgactgtttcttccgtttcaattttctcttcgttgatatcaggcaatcgaaccggctcgggcggtgtttcatattcatattcttcgtattcatcctcttgtgagcgtttctttctgatgaggagaataataagcagaataatggccgcaagcagtacgccgcctgtaatgtatacccagatcggaagacctgaagattgtgccgaatctgtgttcaggcttgtttttccgtcaaacggctgaacggatacaacgattttattgttgatatcattgtctgtcaggttttgattttgcgtttcgtttttatcaagagacgttctgacgaccgttcctaaaatcttctgtatatcagcctgtctctgtgctgataaggaagcggcatttttcggattaggcggctccaccatgacctgaatgcctaaatcacgcactttatacgggctttcagcgatttctttatgaatgcggttgacttcatagttgattttattgctgcttttttcgtagtccccgctgtttgaaccgccgtttgtctcggcatagttcgcggtgtcattgcttcccgttccggccgtgccgccgttggccgcgccgtcgcctttatacgtttccgcaactttttcgacgcttaccgctatgccttccatgttatctttatcgacaggttcgacagtgtcttcagtgcgtttttccttcgtgaagtcaacatccgccgtcacggaaacaacgaccttatcctgccccatcattgtgccgagcagtgactgaacatgtttttgaatgtccttttcgacctgcgacttaataccttgctgagaagcataactgtcagaaacggaccctgcaccgctgtcacttttgtcataatatgtagaattttgatccattatgacgatattatcttcttttaagttcggaacacttttagaaacgagatggtacagcccgttgatctggttttgatcaagcgagtagcccggtttcatctgcaaaacgattgaagcggacgctgccggctgatcttcaccgacgaacacggcttctttcggcatgttgatcatgaccttcgagcttttaataccgtccatttcatttatcaggtttgacaattcggtctgagtcgcctcaacctttaaaacgtcaaactcattatccgtcaggccgaagcccgcattttgtccgaaaaacgaataatcaattgatcccgttttcggcaggccttccgcggcaagctggactttaagcgcatccacttggctctcaggaaccttaatgaccgtgccgccgtcagcaagttcagaagacacctttttcgtatcgagctcttctttaatcttccccgcttcttccgcggacaaatctttataaagaggcaccatcttttcagacgaagtaaaaataataacgacgatgagtaaaataatgaatgcggccaagccgcttaccatgagtatcttctgtgtttttgatctgttgttccaaaacgctgccgttttggttttcatttgcattagagtacgattcatgttaacccccggtcattccagtcattctcttcaatctgaccactacatctgcattctcatgatttcctgataggcttccacggctttattgcggaattcggtagcggccgtcagagaaatatttgctttttgggcagcgatcatgacctcgtcaaggtttacatcctttcctgcagccagttcgttcgttatttggtcagatttcacttgtgactcatttaacgaatcaatagagttttttaaaagctccgaaaagcttgtttggtttgaagaatcagttttttgagtttggtttaattgattcgttacgttttgagtattttgggtttgttgaagctgaaaaggagtaatagcgttaaccacttacatcaccttactttccgatttctaacgccttcaaaagcatgcctttggaggcgtttaatgcagttacgtttgcttcgtatgatctcgagctgctgacaagatccaccatttcctttaatggatctacatttggtttttgtacatatccgtctttattcgcatcaggattctccggatcataaacgagattaaaagcggacgggtcttccgtaacaccagatacctttacgccacttcccgcgcttcctgttccgttcatcttggaatgtaaaagggacgaaaatgattcgcctccggattggagagataccagctttcttctgtaaggcacccattcgccatttacctgcttcgctctcgttgtatccatattggccaggttggacgatacgacgtccatccggacacgctgtgcagttaaagcggaacccgaaatatttaagctttgaaagccactcattattttcctcctgtcaagacggttttcagagaattgaatttgccgctcattctttcaaccaaagcctgataattaatttggttttcggctaaatctgtcatttctttgtcgatatcgacattgtttccgttttgctggtacgatgtatcactgctggacacgatagaataatcgtcccccgaacccgtaaagtcaacgtgccgatagtcggtttttacagcctcaagattggatgtttcctgatctaacaaatttcggaaagagactttttttgccttatagttcggtgtatctatattggcgatattattagttaagactttttgcttaatgtccgctctccccaaggcattctcaagattttgtatagttccagaaaataagtccaaatccacttacctccatttcagatatttttctcctaaaaatccttgtcgagaattgtaaaaccatatgcttattgtaagaaataacaggcttaaagtctatgaagttaggctaaaaaaaagtgctcaattatatctattttgcatgtaggtattaagtcctagaatatttgtactacaaggatttgtttaatataagactgaaaatagcagaatttctgtttcttcctccttttttcacacagcaagatggattatctcagatcagattccaataagcaactttaaactgcaacttttcacctattgtccataaaaaaagcagaacccccatttttagggatcctgcttttgtcttaatgagatttaaggttttccaattcaataaggaatttgttgttcagaactttaatgtacgtccccttcattcccagtgatctggattcaatgacgcctgcgctttccagctttctcagcgcgttaacgattactgaacgcgtaatgccgacacggtccgcaatcttacttgccacaagcaagccttcgtttccgtcaagctcttcaaagatatgctcaatcgcttcaagttcactgtaagacagagaactgatcgccatttgaacaaccgctttgcttcgcgcctcttcttcgatttcttccgctttttctcttaaaatctccattcctacaacggttgctccgtattcagcaagaatgagatcatcatcttcaaattgatcctgcagacgggacagaatgagcgtgcccagtctctctcctccgccgatgatcggcacgatcgttgttaagcccgcttggaacaggtctctgttttctacaggaaacgccgtgtattcgctgttgatatcaaggtttgaagacgtctccggaacattgaacagatttctcgtgtactcttccgggaactggcggtcttcaagcatttttttcatgcggtcattttcaatctgctgattaatagagtagcccaaaagctttcctctgcggctgacgacgaaaatattagaatcaatgacgtcacgaagcgtttcagccatttctttaaagtttacgggtttgcctgccgcagcctgcagcatgctgttaataattcgtgttttttgtagtaaagccatgataaataatcctcctagaattcctcttattaaattttcacaatataaattgacttagatctttgttgtttgcaatcgttccgagcttttcttcaacgtattgcggcgtgatggcgactttttccatcgtaacgtccggcgcttcaaacgacaggtcttccaagagacgttccaatatcgtgtgaagccttctcgctccgatgttgtccgtatcctgattcacatgataagccacttcggcgatcttacgaatagcttcgtcagaaaattcaagagatataccttctgtctgcaataaagcctgatattgttttaacagcgcgttatcgggttcgacgagaattttcacaaaatcatctaccgtcagcttgctcaattctacacgaatcggaaagcggccctgcagctccggaatcaggtcagacggtttggccatatggaatgccccggctgcgataaacagcacgtgatctgttttgacggagccgtatttcgtgacgacggtagatccttcgacaatcggaaggatatctctttgaacgccttctctcgatacatctgctgaggaagaagcccctccgttttttgcgattttatctatttcgtcaataaagataatgccgccctcttcagctcttaacacggcctcttggccgacttcatccatatcgattaatttgcctgcctcttcattggtcagaaccttccttgcttctctgaccgtcattttgcggcgttttttcttttttggcaccagattgctcagcgcatcctgcatattcatgcccatctgctccatcccggagccttgcagcatgtcaaacatcgacggctgctgctcttccacctctacggagacgtaatggtcttcgagctctcccaatgcgagctgatgcgccatgcgctttcttttctcttcaaggcttgcttcttcctgctggtcggcttcatcatcatttgccgcctggcttcctccgaaaagcatttcaaacggatttttcacacccgcttgttttttctttcccggaacgagaagccgcactatacgtttgtttgcattttcttcagcctgttctttcacttcgctgattttttcttctttaatgagccgcacggatgtctcaacgaggtctctgaccattgattcgacatctctgcctacatagccgacttctgtaaattttgtcgcttcaatttttataaatggcgcaccggtaagcttggcgatccgtctggcgatctctgttttccccaccccggtcgggcccatcatcaggatgtttttgggaacgatctcgtctctcagtttttcatcaagaagacttctgcgatagcggtttcttaatgccacggcgacagcttttttcgcatcctgctgtcctacaatgtattgatccaaccgatctacgatttgtctcggtgttaacggtttgttttccatgcgcctcaagtcctttctattcaagttcttccaaaatgatctgatcgtttgtgtacacacaaatctcgcccgcgattttcaaagcggcttttgcaatatctttggcggacagattctctccggcataggttttcagcgctcttcctgctgacagggcgtagtttccgccggagccgattgccaaaatgccgtcatccggctcaatcacttcacctgttcccgatacgagaagcaaggtatcctggttcatgacaatcagcatggcttccagcttgcgcagcactttatcgctgcgccattctttcgcaagctcaaccgacgcacgttttaaattgccgttgtattcttcaagcttcgcctcaaacatttcaaaaagtgtgaaagcgtctgcaacagatcccgcaaatccggccagaacctttccgttaaacagctttctcacttttctcgcggtatgtttcatgactacagcctgaccgaatgtgacctggccgtctcctgacatagcgcttttcccgttatgctggacggcaaaaatcgttgtcgcatgaaaagatgacatgagaagggcctccttttaattttctttaaaagctctcgggtggtgggacatatatgtgtttctcagcatttccttcgatacatgtgtgtatatctgcgtagaagacagattggaatggcccaaaagctcctggacgcttcttaaatcaaccccttcattcagcagatgagtcgcaaacgtgtgccgaagcatatgcgggtgtatatgtaaagtgccagatgctttttttacaagcccgcttaaaatatacctgattcctctggcggtcagcgggccgcctctttgattgacaaacagcacatcatgaggctcttttgctttttcaagcaggcactgccttccgctgttgatatacagctccagcgcatcacgggcatatgagccgaacgggatatagcgctgcttcttgcctttcccgtgaacgagcaccgtatccatgaacaggtcaagatcgccgacagtgagcgtacagcactcactgaccctcattccggtcgcataaagaagctcaagcagggcctgatcgcgcatccctgacggctgacttctgtctgaaacagcgaatagttcctcaagttctttttcataaagaaacttcggaatccgtttctcttgtttcggcagatgaacaagctgaaacggattctcttcaacaagcttttccctcattaaaaatttatagaagcttctcaaagctgaaattttcttgctgattgtttttcttgacaggcctttttcataagcctccgtcaaaaatattctcacatcatgatatgcagcttctttcattccatttatattttgagcatgcagaaacatcccaaattcttcaatcgaattaacataattcacaatagtatattgtgaataatttttttcaatttgtaaatattcaacgaataactttaaaaaaaagttaacattctcagtcattatgaagacctccctctccgaagggcttttaaatggtatcatataatgcatcgaagttgcaatgaaaagctatatcgttttcgaaatagtttgaatagtctcaattgcgcgtttagcgtattcttcatttcgttcttttttgtttttaatttttacaggcaattcttttaagaggccgaagtttgcattcatcggctggaagttcttctgatttgtcgtcgtaatgtagtgagccatgcttccgatcgccgtctcctgcgggaatgtcacaagatcctgaccgagcacaagtttggcggcattgattcccgctacaagacctgaagcggcagattcaacataaccctctacgccggtcatttggcccgcgaaaaacagatcgttccgctgtttaaattgatatgtcgggttcaaaaggctcggcgagttgataaatgtgtttctgtgcatgacgccgtatctgacgatatcaacattttcaagaccggggatcagtttaagcacttctttttggtctccccattttaaatgtgtctgaaaacctacaatattataaagcgttcccgccgcatcatcctgtctgagctgaacgactgcataagggcgcttgcctgttttcggatcttccagtccgaccggtttcatcggtccgaacagcattgttttcttgcctcttttcgccatgacttcaatcggcatgcagccttcaaagaagatttctttctcgaattcttttaaaggtaccgtctcagccgtcgtcaatgcttcatagaaacggtcgaactcttcctctgtcatcgggcagtttaagtacgccgcttctcccttgtcataacgggattttaagtacactttctccatatcgaggctgtctttttcgacaatcggcgccgccgcgtcataaaaatacagatactcttctcccgtgagctctttcagctgctgagaaagcgattctgacgtaagcggtccggtggcgataacagtcgggccttccggaatctctgttacttcctcagtaagaaccgttacgttcggatggtttttcacgagatccgtcacgctttgcgcaaattcatgacggtcaacggcaagcgctcccccggccggaaccgagcatttatcagcagattgaatgattgccgagtcaagggcccgcatttcttcttttaatacgcctaccgcattggcgagtgtatttgaacggagggagttgctgcataccagttcggcgaatttatcagtatgatgggctgccgtctgcctgacgggccgcatttcatatagtttcacttgaattcctcgttttgcaagctgccatgccgcttcacttccggcaaggcctgctccgattacattaactgtttgctggttcatttcttttcatctcctgttgtttgtcccttccacacaaagaaggtgagcaaggctctgctcaccgctacttctgtggttcttccttataatcgcattcgacgcattggacttgtatgccttttttaagctttttctctacgagcatattttcacatttcgggcattttcgttcaatcggtttgtcccaagatacgaagtcgcattcaggataacggtcacagccgtaaaagatgcgtttcttttttgattttcgttcgacaatgtttccttcatggcacttagggcattttacgccgatttgtttgacaatcggttttgtattccggcagtcagggaaattggagcacgccataaatttgccgtatcggcccattttataaaccatccgggagccgcataactcacaatcttcatcggcgtattcaggttcaatttccacttctttcatttcggcttccgcttttttcacgcgtttttcgaaatcagtatagaagctgtcaatgatttgaacccattctgtctggccatcttcaacatggtcaaggtctctttccattttagccgtgaattcaacgttaatgatttccgggaaaaactccatgataagatccagcacgatctgcccaagctcagtcggcacaaaccgtttattgtctaatcccacgtaaccgcggcgctggatggtgtcaagagtcggcgcatatgtcgaaggacggccgatccccagttcttcaagcgttttaaccaggcgcgcctctgtataacgcggaggcggctgagtaaagtgctgctcaggctcaatatctttcgataaaaccgtgtctccctctttaaggtccggaagcatgcggtctttttcttccagctgatcgtctttaccctctacatagactttcatgaagccggcgaatttgactttacttccgtttgcccggaatgtcaatccgttattgctgagatcgacgctcatcgtatcaaggacggcaggggccatctggcttgcaacaaagcgctcccaaatcagcttgtataatctgagctggtctcttccaagcaccgcttttaagtcggcaggttttctgagcaccgaagtcgggcggatcgcttcgtgggcatcttgtgcgttttcatttttctttgccggtttccgttttcccgctaagtactcttttccgtacgcctgatcaataaaagctgacgcttcttcaacggctgtattggaaatccgcgttgagtccgttctcatatacgtgatgagcccgactgtcccttctttgccgagatcaattccttcatataattgctgcgcgatcatcatcgttttcttcgctctgaaattcagctttcttgcagcctcctgctgcagagtggacgttgtaaacggcagagcgggatttcgtttgcgctcttttttcgtaaccttgtcaactgtatacttattgcctttcagctgagcaaggatggcttttacgtcttcttcgctttttaaaggaagctttttgccgttttttccgaaaaatccggcttcaaacgtctcttttccttttaaaaatgagccggtaatcgtccagtactcttcaggtttaaaatcgttgatttccttttcccggtcgatgatcagccggagcgcaacggattgcacacggcccgcactgaggcctttttttacttttttccaaagaatcgggctgattttgtatccgacgagtctgtctagtatgcggcgcgcctgctgcgcatcgacaagatccatattaatcatgcgcggatgtttaaatgattctttaatggcgtctttcgttatttcattaaagacgacccggcagtccgagctgagatccagatcaagactgtgtgcgagatgccatgcaatcgcttccccttctctgtcggggtcggccgcgagatagactttttttgctttctttgccgctgtttttaattcttttaaaacagggccttttccgcggatcgtaatatatttcggttcaaagttctgttcgatgtcaactcccatttgacttttcggaagatcccggacatgtcccattgaagctttgactttatatttcttccctagataacgttcaatcgttttcgcctttgccggcgattccacgatgactagataatcagacattttcatccccctcaagaggtgttctctctcttttcaagtatcaattcattttagagctgcctttttatggctttcaacatttcattctttatgatgaacgtcattttatacatgaaaataatgtgcaactttaaatcctcactattattaaatattacaataccgtttgtcaaacgatatttcaaaagggttccgtatactgaacgcatcgggcggtcagctctccgtcaatatcctctgcgcataatacagctttcgccccttcttgaatgagttttataggtcctccggaatatggattaaatatggaacccggaacggcaaatacctctctgccttgatcgagagcctggtaagctgtgattaatgaaccgcttttttcttttccctgcacgaccacaattccttcacttaatccgctgattatgcggtttctcatcggaaagtgccattttttcggctttgtttcaggaggatgttctgagagtaggagatggtgttcagccatgtattctgctaacaggagattttcccggggatagatgtgatggaatccgccggctatcacgccgatcgtaagcccttttgccctgatgctcgccttatgagacaatccgtctataccggatgcaagcccgcttacaatgacccagcctttttttgagagttcggcggaaagatgcccaaccgcttttattccgtcttccgtcggtttccgcgttcctacaatcccgatttttctgcctttttcaagaagcagcgtgttcccttttgcatacaagacagccggcggatcataaatcgctttaagccatgttggatagcggcttgatgaaatcggaatgacagtaatgccttcgcggcggtaatcggacagaacttcatcaagttccggatccttgcgctctatttcctgaaaaattgcttccggggctgttttcccttctgataaaacagttaatggatgcggatccggtaaaaaagacagagaatgatcagctttccaccattttaatagaagagacggggaaatgatttgattaatactgcagaccattaaacagcgcgatgcttgatccaaatctggaaacctcctctttttttcagcaaaaacaggaacagccgttacggctgcccctgcttcgatcagtgcgttttgcacgtttcaaataagcctttttcttttaacaccttaatcagcgtttcacccattacagaaggggtttccgcgacttcaattccgcaggcgttcatcgttttgactttttcttctgccgtgccttttcctccggagatgatggcgcccgcatggcccatgcgttttcccggaggcgcggttttaccgccgataaagccgacaacaggcttcgtcatgttcgctttcacccactcagccgcttcttcttcagctgtgccgccgatttctccgatcatgatgacagcatgtgtttcaggatcttcattgaacgcttttaacacgtcaataaagttcgtgccgttgaccggatcgccgccgatccctacagcggtagattggcctacgccggcttctgaaagctgatggacggcctcgtatgtcaatgttcctgaacgggacacaacgcctacatgaccctttttatgaatgtatcccggcataatgccgatcttgcattcttcaggtgtaataacaccagggcagttcggccctattaatctcgttttcttgccttccataaaacgcttcactttcaccatgtccaaaaccggaatgtgctcagtgatacaaatgacaagatcaatttccgcgtcaaccgcttccataattgcgtccgccgcaaacggagccggcacgtaaataactgacgcatctgcgcccgttgtatgaaccgcttctgcgaccgtattgaataccggtacgccttccgcttccgttccgccttttccaggtgttacaccgccaacgatattcgtgccgtattccagcatctgctttgtatgaaataaagcggtagaacctgtaatcccctgtacaataactcttgtatctttattgataaaaacactcattatctggtcccctgcctttcattctttcctaaactaaggatacgattttctgtgcgccgtctgccattgattccgcagatgtgatgtttaagcctgattcattcaggattttctttcctaaatctacgtttgtcccttcaaggcgcacgaccagcggcaatgtcaagccgacttgtctcgtggcttcaacaacgccctcggcgatgacatcgcacttcatgatgcctccgaaaatattgacgaaaattccttttacgttttgatcggaaagaatgattttaaaagcttccgtaactttttctgcggttgcgccgcccccgacatcaaggaagtttgcaggttctccgccgtagtgtttaatgatatccattgtagacattgcaagacccgcgccgtttaccatacagccgatatttccatcaagggaaatgtagcttaaatcgtattttgacgcttcgatttctttcggatcttcttcatctaaatctctgtattccataatgtctttttgtctgtataacgcattgctgtcgaagttcagcttagcatccagcgccatgacgtttccgtcccccgtaacgacgagagggttgatctcggcgatggagcagtccttttcaacaaatgctttgtataaaccgagcataaatttagcggctttgccgacaagctctttcgggatgttaattgcgaatgcaatttcccttgcctgatagccctgaaggccgacagccggatcaattaccgcttttttaattttttcaggagttttttccgctacttcttcaatctccgttccgccttcttcagacgccattaaaacgattcttgaagtagcgcggtcaagtacaagcccgacatagtattcctttttaatatcgcagccttcttcaataagtaagcgttttattacttgtccgtccggacccgtttgatgtgtgacgagcgtcttacctaacagttcttcggcatactctttcacttcatcttttgtttttgcaatctttaccccaccagctttgccgcggccgccagcatggatttgcgcctttacgacataaaccgagcttgacaggctctctgctttttcaactgcttcctctgctgtaaaagccactttaccttcaggaacagacaccccgtattttctgaggacttcttttccctggtactcatggatattcatttcccatcctcctaacttatgtagcaaaactaaaaatagactgcgctttcattctatataatactggaagaattgtctagggttcaaaacaaaatctttatatccttccaaacattctaacttttattttattgaaaatataaatttaaacggagtccgggaaatgaatggtccttatttttcgtttttcagggtttcgtccagtttgtaaacaaatgaaaaaatttcggcaacggtttcataaagcgcctccggtatctgatcgtcaaccgtcaaatggcgcattaattcgacaagggttctgtcttcctgaatgggaaccccagccttctcagcttcttttataatattttccgccacgtgccccctgcctgttgcgacaacctttggggcttggtctttctgccggtcgtaatgcagggcgacagctcttcttaacggcgtttgctctttcatattttcacatccacttttcttccgccgtctttttctataaactcttccacaagagcgctctggtctttcgggcgccgttttttagccgtgacgcctgacaggctgaagcccgtttcttttacagctttttttaaagccggtacgagagggtcgatggccgcctgaagctcaaaatcagtctcaaccgtaatggtcattacattttgctgaatcatgcagtccacaacggtttcttgcagtgtttcaaggtgcagcaaaaacaggagcctgcaatgtgacggatcgagttttccgtccggcttcttccgtcctttaaagagaactgtgatgtcattctcatacgcggacgctcccagcggaaatgacagcaccatctgcgtaacagaaggattatgctgctcaataaacagctggccgtttaatttatgaataagcggttccgcctcttgtttaacggattggggcgcctcttgaagcgtccggacggcttggagggctgttttcagtgcttgtttctccggctgcggagatacgcctttttcaagcgctgtaatgaatgataattcatcacgcgtgcccagtccttttttgattttctgcaaaaggcttaatacatcatgtttttctgcatatttcaattcggtgagctgagcggctttttcaaaaacagccgcctcctgttctgtcagatgtgcgttttgaagaacaggtgctgttttaaatgttttttcttgagaaatgaaagccttaatgatctccgccgttacttttacgggacggttttcagttttttctgccgatgtcattaatttctctataatctgttttgccgttttttcaggcagttccgtatctgtccgtgcactcggaggagaaggttggcttgagactgcctttccgttttcacgagtctctcggacaaatggtgattgttttgattccgtccgttctccttcatccatcagcccggtttctgagagcggcatgcgtgcagcctcggcaagcttcttcaagagacgttctgcatgaagatccgtttccgcgtttaacacgtcagaaatcgcctctttgagcacagacagctcttttgccgattgcggagcctgattgattgcctgaagcagtcctgagaggaggcgccgggtcggaaccggatatttaacggcatgaatggctgacaagacttccggatgtgcgggcagttcccgtttcagcgcaaatacgattgtttccgccgcttttttcaattcggcggccggaagcgattcagcccagcggatgcaagctttgaggctgttttccgtcatcggcagcttctgctgcataaacgtttcggcaatctgcagagacacagggcctggtttgacggaaagagcgtttaacagtcttcccgccgcttcctgaacggttttcgggtttccttcgaattggtcgatgacatgaagccggcccgttttttccgccggctgtttgtcataagaaaaccagtaatacgcctgcggacgaagggcggtttcaagttttccctgcatcgtccggccgccgatttggataagagcgctttgatcgtccagcaaacggagaaccttccctaacagcagcctttgagcgccgctgtctttaccgccgtcttgccggtccggagggatttccgccgtcagctgtctgaaagccgcttggatttcgccgcttatgttcatgtcttaagcctcttttctaacaataagattgaacgggagcgaacgtttttcggtgaatagttgtcggtccgtatgcctgaagagcttcaagatgttctttcgttccgtagcctttatttttttcaaagccgtacatggggtaggttttggcgtactcagccatgagacggtcccgcgttacttttgctatgcaggctccggcggcaattgacacgcttttggcatccccttttataactgatgactgcggaatgtcaagcggcagggtcatggcatcaacaagcagataatcaggtgtttccgttaaagcattgacggcttttaccatcgccagtctcgcggcctcataaatgttgatccggtcaatgacgtccgcatggacaatgccgactcctacagccgccgcttcttccgtgatccggctgtaatactcctcgagcttcttttccgacaatttcttcgagtccgtgagaccgagaatctcgcattctgccggcaaaatgacggcgccggcgacaaccggtccggcaagcggccctcttccggcttcgtcaacacccgcaatcaggcggaagccctttttggatgacagtctttcgtatgccgtcatgttcagccattgctctttaagagctttttccttcgcgtgctttttcagccattgctctaaaagcgtctgtacgctttttctcgggtctttctcacattgggcaaggaaggggtcgctttcgtccctgacctcttgcaggcgttcttttacgctttttacggttaatgtattcacgttctcttctcccttacattatgtatatcggtattctgcggaaaaaataaagacccgcatcgctgcgcgtctttattctgatggtgtttcaaatgaaagcctgccgaatttttccgtccggatgtcccgaatgatgacttccgttgttttatcatagtcaaccattcctccgcccatcaaacagccgcgtttttcaccgatcgcgtcgaaaagagcggcgatatcctcagggatttcctgaagtccgtagcgctccttcaagcggtcgggataatgctcttccagaaagcgcagcccgaagacggccacatcctgcaggttgataatcgtatctttaatcgccccggtgatcgccaggcgcaagccgacaagctcatcttcaaatttaggccataaaattcccggtgtatcgagcagctctaattccttgcctacctttacccactgctgtgaagtggtaatgccgggcctatctcccgtcttggcaatgttttttttggccagccggttaatgagcgtagacttgccgacattcggaatgccgatgattaatgcgcggattgctctcggcctaatgccctttgctttcattttatcgaacttatctttcagcagctcttttgaggacggcacgatttgatgcagtccctgcccgttaacggagtttattgaaagagagggaatgccctgttcctgaaagtggtccttccactgggcagtcacagccgcatccgccttatcggctttatttaaaagcataatgcgcggcttattttttaaaatctcctcaatcatcggatttctcgatgacatcgggattctcgcatccaccaattcgtatacgatatcaattaatttcagtttttctgttacttcccgtctcgctttagccatatggcctgggaaccattgaatggtcatgtgacttcgacacctgccttatttaccggaaccggatgttccgatgatctcttatgtattttacgttgcttgttctgcttttacaaatttcatataaaaaaagagcctgttacgggtaacaagctcttttcgttcgttatcattatcgtctgatttctttaatacgagccgcttttccgcgaagttcacgcaggtagtaaagcttagcgcgacgtactttaccgtaacgtacaacttcgattttcgcgatttttggtgtgtgtacagggaatgtacgttcaacgccaacaccgtaagaaatcttacgaactgtgaacgtttcgctgattccaccaccacgacgcttgatcacaacaccttcgaagatctggatacgctcacggttaccctcaacaacttttacgtgtacacgtaaagtgtcaccaggacggaacgcaggaagatcagtgcgaagctgttcttttgtgatatcttgaattagtttttgcatcgttttcaactccttccaacagatgctcttggccacaactgcaaggcacagcggaacatcgttttcaagcttctgaaggataagcctccttaagccacaagtagtatcttatcatatcttcatcgcctgcgcaatagaatctattcgttttcccactcggaaatccattttctttgctcatcagtgagaggatagttttcaagaagatcgggacgtcttaaaaaggttcttctgattgattctttatttcgccatttttgtattttagcatggttgcccgacagaagggtctcaggcacttttaagcctctataatctgcaggcctcgtatagtgcggatgctctaaaagccccgtgctgaaggaatcctccacgtgggatgcttcttttccgaggacgcccggcaaaagcctgacaacgctgtcggcgatcatcatggcagggagctctcccccggtcagcacaaaatccccgatggagatttcatcagtgacaagatgttcccggatccgttcatcatacccttcataatgtccgcaaataaacatgagatgttcctcttgtgccagctcctcggctttcttctgcgtataacgctcaccttgcgggcagacgagaataatgcgcggcttggcgtccgtaccggctgtcagcttttcaaccgcatcaaatacgggctgcggctttaacaccatcccggctcccccgccgtacgggtaatcatcaaccgtttggtgtttattatccgaaaaagcccggaaattgatgacgtcaaaacggacagcctctttttcctgtgctttttgcagaatggaggagccgagcaccccttgaaacatttcgggaaacagtgttaaaaagtcgattttcattcgtctattaacccttccattacatgaatcttaattttcttctcatttatattaatatcctttaccacagaagcaatatacggaatgagcgaatcttttttgccttttcttgcaaccacccatacgtcattagcccctggcgtcaagatttccttcactgtgccgatcagttccccgtcttctgacacaacctcgcagccgatgatttcatgaaaataaaattcatcttcttcaagctctcccaagtcttcttcagggactttgatcaccatgtttcttaggtgttcgacttcattgagactcggcatttctttgaattgcagcaggtgaaactgcttgtgaagcctgtgggcgctgaccgttactttgattggctccgcagccccttccgcaaacaaatagagcgtattgccgggcttgtaccgttcttcggcaaagtccgttttagaaatgacccgcacttcgcctttaatgccgtgggtatttacaattttgcctacattaaaccatctgtttgtcatattatcacctcgggcggatttcaattactaccccgtcttttatgacgatggtatttgccgctgttttttcatgccagttatcaccgacgttgattgaaagcagcgcatcgatctccttttccttcacttcgcttccaagcgggagcgactctgtctggcttatttggaaatcgatcattttgattttgtcttgtcttttctcaatggcttttttaaaagattccgctacatcgggattctgctgatctttttcatgttttctaagctgaaaatagagctggctgcattctcgttcaagcgtttgctttttttctgcaaaagaggccaaaagcttttccttgctttgctcggtcagaacctgcataacggttactctgtgaataatctgcataggaccagactccccactcttccaacatatttctgttcatttgccttttttacgtgtaaaaaaaggggaggtgccggccctctccctttttcagtcaaatatttcaaattgaactttcttagaagactgtgcgccagctgcaaaaacgacggttcgaatcgctcttgcagtccggccttgctttccgataatcttaccggtatctgacttattgacagataagcgcagcgcaatcttttgatcagtctcttcctttgtgaccgttatgtcttccggatggtcgacaagcggagccacaatgctgacaatcaaatcttccaagttctgatcagtcattacttgccttgtttagcgttgtggaatttttccataattccttggcttgagaacaagttgcggactgtatcagaaggtttagctcctgtttgaagccatttaagagcaagctcttcgttgattttcacttcagccggctttgcaaccgggttgtatgtgccgactgtttcgatgaaacggccgtcacgcggtgaacgagaatctgctacaacaatacgatagaaaggagatttttttgctcccatacgttttaaacgaatttttactgccattttactagcacctccgaaaatatttcaacaagatagtatattaacaatgataaaagtgtttgtaaagtgttttttcttaacaacggttttatcatgtataaccgattacataaaaggtaatttaaagccttttttcttcccttttgtcatgttggtcatctgcttcatcatttttttcatttcctcaaactgctttaaaagacggttgacttcctgaacggatgttccgcttcctttggcaatccgcttccgccggctggcgttaatgatatccggctgttctttttcaagaacagtcattgatttaatgatcgcttccacatgattcagctgtttttcatcgacttggatgttttttaagcctttcattttgcctgcgccgggcatcatttgcaacagttcgtcaagaggccccatgtttcggacctggccgagctgctccagaaaatcatccaatgtgaagctcatcgttctcattttctgctcaagctctttggctttgtcttcatcaacggtcgcctgagctttttcaatcaaggtcagcacgtcacccattccgagaattcgggatgccatccgttcaggatggaacgcttcaagagcatcgagcttttctcccattccggcgaatttaatcggcgtttcggtgaccgcgcggatagaaagcgccgcacctccgcgggtatccccgtcaagctttgttaaaatgacgcccgttaaaccgagctggtcattaaagcttttggcgacgtttaccgcatcttgaccggtcattgagtcgacgacaaggaaaatttcctcaggatttgcgacttcctttacgccggagagctcatccatcagttcatgatcgatgtgcagccgtccggcggtatctaaaatcacataatcatgatgctcttccttcgctttttcaatcgcctgtctggcaatttccaccgggctgacctgatcgccaagcgaaaagaccggcatatcaagctgtttccccagggtttccagctgtttaatcgcggcggggcggtaaatatccgcagccacgagcagcggtttgcggttatgttttttgcgcagcaggttggcaagcttccccgtggttgtcgttttaccggcaccttggagcccgaccatcataataacggtcggcgggcgtttggcgacggcaattttgctttcttcgccgcccatcagctcggtaagctcttcttttacgactttaataacctgctgaccgggtgtcagactctgcataacgtcctgtccgacagcccgttcacttacttttttcacaaaatcctttacgactttaaagttaacgtcagcctcaagaagcgcaagacgaacttcacgcatcatctcttttacgtcttgttcgctgacttttccttttccgcggatttttgaaatcgtcttttgcagtcggtcggctaatccttcaaatgccattgtttgccgcctcctaatctaatttctcaagcgcttcaatcagagccgtcattttttcctcttcctgcaacccggaagcaagctctttcagctttgtaaacatttctttacgctcctgaaactttttaaaaaggagcagtttttcttcatattgttcaagcatcgcttcagtccgtttgatgttatcgtaaacggcttgccttgaaacgtcatactcttcggctatttcaccaagggagaaatcgtccagataataaagcgacatatagctcttttgttttgacgtcagcaacgactgatagaagtcaaataaatagttcattctcgtcgttttttcgagcgacatttgagctctcccctttgttaagtcaaatccctttacaaaaacttagtttacatggtttcagagcgtgtgtcaagtttttatcttgtcaaagcaggatgctctttttacataataagttttttcaaaaaaattcatatagaccgtcgttaaaatactcgaattcttgttttgatacacgatagcggcaatagccttcgtaaaaagcattgaggcatgcttcatttgtgacaaaatgactgatcgctaatgattcatcatatcgcggatctcccgccgatattcccgcagcatcgataaacagatagacctctccgtctttcaccagcacattatcagtcgtgcagtcaccgtgaatcattgtctgctgaacaggaacaggcctgcacctgtccaattccttcaaaagctctgcacttccttcagcctgtccttttttgacatattccccggctcgtttgatttgtagatcgagccagtctgtttccggctgtaaaccagagaccatttcggtttcatgcagacgttgcagaaactggccgaaacttttgatcagctttttcttttcagtatccccttttgcttttcttaaagccgaagtcagtgtgattccatcctcaaatgacattacgatatggctggcatgctgttcctgtatcatcccataataaataggaacaggcagacgacgagtttccgtcagtttttgtaaaacgaaggcttctctcattaaccattcccgatacttctgttgaaaagaacttttcagcagaaatgcgtcttggccggtcactattttccgaacggttgaagtgcctccctgttcatccagcagcgacatatggtttatcgcgccgatcttactttccaattcagctttcagccatttgtccaacaactgccccctccattccgatctatcaatgcgtataaaaaaacgagtataaaaccgtccattttacactcgttttttattcattaatcctcggctttttcaactaaatcagaaaagagaccgtatacgtaagattctgcatcaaaccgctggagatcgtcaaccttttctccgaggccgaccagtttcacggggatgtgaagctcattgcggatcgccaagacgataccgccttttgcggtgccgtcaagcttcgttaacgcgatacccgtcacattcgtcgctttggagaattctttcgcctgcgccatcgcattctgacctgtcgtcgcgtccagcgcaaggagaacctcatgcggagcctcaggcacttcgcgttcgatgacgcgtttgactttttcaagctctttcattaagtttactttattctgaaggcggccggccgtatcacaaatcagcacatccgctcctcttgctttagccgcgtgtacggcatcataaataaccgcagcagggtcgcttccggcagcctgtttaatgacaggcacgcctgtacgctctccccacacttcaagctgttcaatcgccccggctctgaaggtgtctccggcagcgagcacaacggatttgccttcattcttcagcttatgggcaagttttccgatcgttgtcgtttttccgacgccgtttaccccgacaagcagaataacgttcaggcgcccgtcctgaatatttaattcagaaatctgttcgtcgccgctgttataaatgtcgacaagcttttcagaaatgacggactgcacttcctgaggatcctggatgtttttcagcttcacttcttttttgagctcatcaatcagctccatgacggttgtaaaacctacgtcagcgccaatcagcacttcctcaagctcctcgaagaaatcctcgtcgactttccggtagcgggagacgagttcgttcactttatttgagaaggaatttcttgttttttcaagaccatctttaaatttttcagagacggagtctgtctgtttcgtgattttctcttttaattttttaaaaaagctcatctttcaacctctttcctcgttactgaacgaattcttttgtttcttccagtttgaccgaaaccattcgggaaacgccggattcctgcatcgtaacaccgtagaggacatccgcttcttccatggtgccttttctgtgggtgatgacgataaactggctgtcgccgctgtatttttttaaatattgcgcaaacctgaatacattggcttcatcaagcgcagcttccacttcatcaaggacgcagaagggcacgggccttactttcagaatggagaataaaagggcaatggcagtcagcgcccgttctccccctgacaaaagatttaagttttgcagttttttacccggaggctgcgcgataatgtccaccccggaattaagaagatcattcggatcagtcagcttcagttcagcccgtcctcctccgaataaagaacggaacacgtcgttgaattgagaacggatctggataaacgtttcatggaatcgcttcgtcatttcagaatccatttcttcaatgacttgaaacagtgtatttttcgcttccgtcaggtcatttttctgctctgttaaaaactgataccgttcgtttactctttcaaattcatcgatgctaccgagattgaccgttccgagctcttcaattgaaagcttgatcagtttgacccgttttctcgcctcttcaggctcgagttcgagctgatattgttcttttgctccttcaaaggataagctgtactcctcgcgtaaatactgcaagagattatcaagctcaacttccatccggccgagttttacctcttcatctttcagaatgtctgttttttgcttgtagagacgcttcatctctttcagttcaagctcgttcgtatcaagagcccgctggagcttcacacgctggtcgcgccggctggcgatcaattcgatcgttctcgttttatcgtgaagcttgtgatgggctgcttcttcaagctgctcctcaccgcttgtgctggacgtcatctctgaggtcagaaggcttaaatcttcccgtgtttctttcagagcgagctgtgtttcttcaagctcttttttcagccttttgaggttgtcttcctcactcgagcacgcctgttcttttttcgcagcggccactttacattccgtcagttcatgagagagcgtttcttttgttgaggatagggtctgcttttgttttgtcagcctttccatctcttcctcaagctctttcagctggccggatgcctcactcagctgttcttccagagctgatttgcgcgtctctttttcccggctgctttcggtcagtgatgctttctcctgatcgtaaagctccagatgggtattgatgttcttttcagcaacttcgagttcatacagcctgccttttacatcctgctgctttgttctgaaagcttcaccgtcttcacggagaccgctcagcgtatgttcaagctcttgaatggcctgcttcagcgttttgacctctttttcgagcagagctgttttttcttccatttcggcaagccgcgcagtcaccgtctcaagctcacggcttctgccgagcagagaattgtttttctttttgaccgcgccgcctgtcattgatccgcctggattgacgacatcgccctcaagcgtcacgatgcggtagcggtgcccgagaagcttggccagttcattcgcgccttttaaatcttcagtgatcagcacggtgccgagaaggttttgaatgacattccgatacgcggcatcatatgtgacaagcccgctcgctgtgccgaggaaagacggatgcttctgagccgtctgttcatcacgggtttggagctggcgcggtttcataaccgtaagcggcaggaacgtcgcgcggccgaatgaattctgttttaaatattgaatcgctttccgcgccgcctgctcgtcgtctgtgacaacgtgctgcgccgctgcgccgagtgcaatctcgatcgccgtttcatacttttgttcggtggcaatcagttcgagaacggcgccgcggatgccgccgagcttctctttctgcttcagcacttcttttacgccttggtaaaatcctgaaaaatcgccttgcatcgtttcaagcatatcttttttggatctggcctgctggacgaattgatatgcctgatacagcgctgattctttcttttcatactggcgttttttctgttcatatgctgtctggacttcgcgaaagcggacgacctgattgtgaatatcctcttcaacggcagccaattcttcttcgcacgccgctttgcggactgcaatatcgttacgttcttcaagatatttttcattgtttgctgtcagtctcgcctgctggaccgcggattgggacatctggtcatctaaaagctgcagctcgttgcgaatcgacgcctggctgtttaacaattcaaagtaatcgctttttaattgttcgattttctcatctacattttcattatgcagactgagagcctgctgcttttctttcacttgggcgtttaaccgcttcacttccgcacgcagcttatcatagacggcagactgtttttcaatgtccgctttcagttcggcttctttgttcgtgtaatgtgtaacggattcctcaagctgttcccggttttgcgcggcgttttttttgcgctctttcagcacttctttccggccttccagcttttccagctcttcacttgtcacgagcagaacctgctgcagttcgttgacggattcatcaagcgcgtggattttatctctcgtctcttctatcatcgcttcttttgcggatagagccgatgattccgccaattcttcttctttagcagcctgcaccttgtcttttaaacccgaccatctgccatgcagttgttcgatgtcaaaggcggtaagggcgatttcgacatgctcaagctctttctttttttctaagtagtctttggcgattgatgcctggattttcagcggttcgacctgatcttcaagctcgtgaagaatatcttccaccctgtttaagttatcctgcgtctcaaacagtttgttttccgcttttttctttcttgttttatatttcagcacgccggccgcttcttcaaaaatactgcggcggtcttccgctttgctgctgagaatctcttcgactttcccctggctgataatagagaatgcttcttttccgagcccggagtccataaataagtcaatgatgtctttcaaacggcactgctgattgttgatgagaaattcactctctccggaacggtacacccgtctcgtcacgctgacttcgtgataatcgatcgggagaaaatgatcttcattatcaagcgttaacgtgacttcggcaaggttcagccgcttgcgtgaatcacttcccgcaaaaatgatatcttccatttttccgccccgaagcgagcgggctgattgttcgccgagcacccagcggatagcttcggtaatgttgctctttccgctgccgttcggaccgacaacggccgtgacgccttttacaaagtcaacggatatccgttctgcaaatgatttaaatcctataacgtctaaacgtttgaggaacatcccagatcctccttatcgtataagtatctcaatattatcataatcacccgcttatatcaggcgcagacatactgaaatccccctagggatacagggggattttattgtttcgtatgatgtttttgcaattttgcaagagcttcctgtgccgcatgctgctcggcttcttttttggaacgtccgttcccgataccgagcgcctcacctttaagagagactagcgcctcgaattcccggttgtgggcaggccctttttcattgagaattttgtactcaagcgatccttttccgtcccgctgtacaaattcttgaagctggcttttgaaatccatcacatgagaaaaagcaccatcgtttattttagggaacacgtacactttcaggaattgctgaaccgggtcaaggccctgatccagatacagtgcgccgataaacgcttcaaacacatccgctaaaagcgcaggacgctttctgccgcccgtcatttcttctccttttcccaagagaacaagatcgccgaatgacaattcatgggcaagtgagacgagtgacggctcgcatacgatagcggctctcagcttcgtcaaatctccttcactcatggccgggtatttggcaaataagaattgggagatcgtcagttccaaaacagcgtcacctaaaaattcaagcctttcattgtcttcatacggctttttccgatgctcattcacataagatgaatgtgtaaatgcttgatacaaaagtttctcgttttgaaaatgaaccgaaatccgttcttggaactctttaaattgctctatttttttatagaacttttttttatctttaaaatgtgagtgttttgacatagtaacctccataggcacatcaggttcaccgcgctccccgccgtaaacggaatcggcagcgcgtacagcgtcagacgccggtaaccgaacgattaaagggctaaagccccgctgtcaggcgggacttttagcatcagcttattgctggttttgtatgtagttcacagcgtcgccgactgttgcaatcttttcagcatcttcgtcagaaatctccatatcaaactcgtcttcaagttccataacaagctcaactacatctagggaatcagcacctaagtcttccttgaaagaagcttcaagtttgacgtcagcttcatcaacgccaaggcggtctacgatgattttcgttacacgctctaatgtatctgccatagcaattcacctcccctcaagtattatagaggattcgtttttaaaaaactagagaaactaggatgaaattttaaaaacaaatctttacatcaccattccgccgtcaatatgaagggtttggcccgtcatataacgcgatccttcagaagcaaggaacgtaacaacgctgctgatatcggaaggatcaccgaaacgcgcgagcggaatctgcttcagcatttcatcttggacttctttagaaagcttgtccgtcatatctgtagaaataaagcccggagcaatggcattaaccgtaatattgcggctcgcaagctctttggctgatgacttcgttaagccgattacaccggcttttgccgccacatagttcgcctggccggggtttccgctgacgccgacgattgatgatacgttgataatccggccggagcgctgtttcatcatctgtcttgtcacggctttcgtgcagttgaatacacctttcaggttaatgttaatgacatcatcccattcattttctttcattctcatcagaagattgtcttttgtgatccccgcattgttcacgagaatgtcgattgaagaaaatgcagcgacagcctctttcatcatgttttgtacttcttcggaatttgatacatcggcttttaccgcgatcgcgtttcggcccaaagatttgatttcatctacgacttcgttcgctttcgcttcattcccggagtagttgactactacgttacagccgtttttcgcaagatcaagcgcgatcgcccgcccgattccgcgggacgctcccgttaccactgctgttttttcattaagcatcctgattctcctccttcagcgtttgaatcgccagttcgatggtttcatggtcagaaaccgcgattgttttaaggcggcggttcacttttttcacaaggcctgaaagcacttttcccggcccgatttcaacaaacgtcgtgacgccttcgtcaatcagtttgttaatggtttcttcaaagcgaacaggtgaatacagctgttcgatcagttttttcttgatatcgtctttttctgtcataacgtcagccgaaacgtttgaaatcacgggaacagccgcattttttaactcacaggcgctgagcacctcctcgagtttttgcgctgccggcttcattaattcagaatggaacggtccgcttacttctaatgggattgcccgttttgctccgttgtttttcgcttcttctgaagccagctccacgccttttgccgttccggaaattacgatctggccggggcagttcaagtttgcaagctgtacgagatgaccgttttccgtcacttgatccgtcacctttttcaaggactccgcatccattccgagaatagcggccatggcgccttctccggccggcacggcttcattcatgaattctccccgttttcttaccgtgtaaacggcatctttaaatgtcatcgctcccgccgcaacaagcgccgaatattctccgaggctgtggccggcggtgaaatcaggggtgatgccggattctttaaacttttccaatacggcgatgctcgttgtcaacagcgcaggctgcgcattgtatgtaagggtcaattcttcggcgtcaccttcaaaaatgagcgagctcagctttgtttcaagcgtttcgtccgcttcatcaaaaatacgttttgacgcttcttcgcgttcgtacaggtcttttcccataccgatatattgtgatccctgtccgggaaataaaaatgcaatcttactcatgatgcggtaacctccagactactcatctgttttttcttcttttacttcttcttctataaatgcggccacgttttggctgaccatttctctcgcctggcgcagcgcatggtaaacagcgcgtgcgtcagaagagccgtgcgctttaacgacgggcgctttcaaaccgaaaagactcgccccgccgtactcagaatagtccattttcagtttcatttccatcagcttcggcttcagcactcccgctgcgagcttagaaacaaaacttgaagtcagtgtatctttcagcattttgaaaatcgataacgctgaaccttccaatgttttcaacgtgacgttgcccgtaaagccgtctgtgacgatgacgtcagcagcgccttcgagcaagtctctcgcctcaacgtttccgacaaaattcacgtttgtttcttttaataattcaaacgtcttttttgtcaggtcgtttcctttcttttcttccgtgccgacatttaacaatccgacgcggggcgagctgattccgagaacctgccgggcatatacagatcccataattccgtactggacgagatgctccggtttggcatcgacattggctcccacgtccaaaagaaggaaaccgtcgcctgaaacggtcggaagcgtcggcgcaagcgcaggccggtcgattcctttaattctgccgacgataaacagtcccgctgtcatgagtgcgcccgtattccccgctgagatgcaggcgtccgctctgctttcagccacttcctgcgccatcagcaccatagaagagtttttctttctgcgtacggcgcggaccggttcatccgtcggttcaatcacttcatcggcgtgcaacacagtgatgcggtctgatgttgttggcaagtgtgattctatcgttgtcttgtcaccgaccagcgtaatatgaagatcgtcaaatgcctcaatactcttcattactccgtcaataacagctttgggtgcgttgtcgccccccattgcatctacagctattctcatgcatgctccacctttatgattgttttgaacgatacatgtcaaagctgccggagaacacgacttcttctcccacatagctgttgacttcaactaccgttctgcctttttctttttcgactgccgtcactttggctttcgcaacgacgcgctcgccttctttcacctgtcttgtaaagcggatatttgcgcttgcggtcagcgccagctcatcatcaatgacggctacggcgagtgagttcgcctgcgcaaacaaatgatgcccccgcgcaatttgattgcggctgaagacatgttcgcgtcttacttctaatatggaaatggcctggccgtcaagctccagatcaataatttcaccgatcacttcgtctaaagacagtgatttcacttcatcatcaagcgtttgttctgccacgtttttaattctttccctcagctccggtattgagagctctaagcggtctaaacggatcgtctgaatgctgacgccgaatttccccgctaattcttcatctgtgatgaagggtgtcgatttgatcgtctgctgcaataatttttggcgttctttcttgcttcttctcatctgtaaacaccatccggacaattaagactaggtactaatagtagtatataatctcatagattggaatgcaatgattgttttttgaaagccgccgaattttgcagaatcagcttaatttctccccttccaggacgccgcttgaaagtaattgaccgcgcagcatgcggtattcgtcatctttccaaaaagcctctgaagacaccagattggccgcatcctggcgggccgtctccaaagctctgtagtcatgaaccatatccgccaccttgaactcgggcataccgctctgtttttttccgaagaaatcaccggggccacgcagttcaaggtccttttcagacagctcgaagccgtcgtttgtctctgacatgattctcatccgttccttcccggtttcggatttcggatctgccatcaagatgcagaaagattggtggtctccccgcccgacccggccgcggagctgatggagctgagataacccgaaacggtcggcgtcatagatgaccataatcgtcgcattcggcacgttcaccccgacttctacgacggttgttgacacaagtacctgacattgattggcgctgaattctctcatcacctgatctttttcatcagaatggagcttcccgtgcatcaggccgacattccatttaccgcggtaaacgtcagacagcatgttatatacgtcaatcgcattctgtacatccagtttatccgactcttcaatgagcgggcagataacataggcttgccttccctgcttcagctctttttctataaaagccaaaatccgctccagcatgtcgtgtttcacccaatacgtttcgatttgttttcgccccgcgggcatttcatctatcacggaaacatccatttctccgaagacggtaatggccagcgttctcggaatcggagtagctgtcataaacagcacatccggatcctgacctttattcttgagttttttgcgctgttcgaccccgaaccggtgctgctcgtccgtaataacaaggctcagcgctttgaattccacttcatcctggattaaagcatgggtccctactaaaatatcaatctctccgagagcaagccgctccaaaagctccctgcgccgctttcctttgacagaactcgtcaaaagcgcgatatttacatcttcatttgcaaacaacgatacgagagaatctgcatgctgttcggccagaatttcagtcggcaccattaatgccccctgataccccgacaaaatcgcagcgtacaaagcgatggcggcgacggccgttttccctgatccgacatcaccttgcagcagacggttcattcggtaaggggatgtcatatcagcggtaatttcccgaagcacacgcgtctgtgcggtcgtgagcgaaaacggcaggctgtctgtgaaagcggcgagcttttcagcaggaaacacatggctgatgccttttgactgttccctttccgctttacggaacgcctgcattttcagctgaaataataagaattcctcgtaaacaaaccggcgtcttgcctgctgtaacgattcccgcgtttcaggctgatgcatcgtctgcagggcatgtttgtagtcaggaagcttgtagcggattctcaatttttcaggaagcggatcagccgcactgtccaaatgatgctgcagcgcttccttaataaaccgtctcatcatttttacggtgacgttttctttaacggaataaacaggctcaatgcttttatcttcttgatgaggaccgttttttaattcctgcacggaaacggtctgtctgtgtttatcccatttcccggatatcgtgacgacagaacctaacgtcagtttcttttttaagtagggacggttaaagcagaccgcggtaattaaataattgccgacaagcactctgaatgtcagcctgtttcgttttttgccgtaataggtaagagaaggttctgaatgaaccttcccttctaccgtcactctttcttcatgttttacttcttctaaatccctcagctcatagtcatcataacggtaagggaaataattcagaagatcagaaatgtcatagataccaagttcgtgcaatgttttttctgtttccggcccaatgcccttaatttccgctatactagtttgctgatggtgtgccacttgatttcagcgctcctccgaaaatttttttctctaattctcttcccgtcggtgtcgcggctaaaccgccttgtcccgtttcacgcagtgctgtcggcattgtctggccgattttgtacatcgcgtcaatcacctcatcgcaaggaatgcggcttgtaatcccggccagcgccatatccgccgcgatcattgcgttggatgctcccattgcgtttcgtttgacacacggcacttctaccaatccggcgaccgggtcacatacgagaccgagcatatttttcagtgtaatcgccattgcttccgctgattgctgaggcgttccgcccgccatttccacaatcgcagccgctgccatgcctgatgctgacccgacttccgcctgacagcctcctgccgctcctgaaatactcgcattatttgctacgacaaaaccgaacgcgccggctgtaaacagaaaacggatcatttgttctgtcgtagggttcagcttatgctttacggcgaataacgttcccggcacgaccccggcagagccggcggtcggtgtagcgcagatcgttcccatcgccgcattgacttcatttgtcgccacagctttagaaacggcgtctaaaatcagattgcccgacagacttcttcccgattggatgtatgcctgaagtttcacggcatctccgcctgttaaaccggtctgactcgtgacgcccttcagccctttttcaacagctgcttccatgacggagagattgcgctccattccttgaaagatttcttcccgcgttttttgcgtcacttccatctcttgggtgatcatcacttccgaaatcggaatttgtttttcttgagtgatttctattaattcttttacattacgaaacatgtcattttcctcctgactttttagtcagctatcttagtaacctgtataatattaggaagtgttgaaagctcgtcaagcacttcttcttcaatattctgatcgacctcaatcgtcatcagcgcaagctggccgacgtccttacgcgccacttccatatgtccgacgttgatggagaatttcgcaagcacattggcaacgcctgcaatcgtgccgaatttatcattgtgaacgactaaaatagccggatggtttccggacaaacgcagctcaaagccgttgagctccgtgatttctatttttccgccgccgatggaaataccggtaagggcaagctctccctcatcatcagaaatgacgatgcgcgctgtattcggatgaacgggcacggcatcctctgtacggaactctacatatatgcccttctcttccgcaatttgaatcgctgttttaatccgctcatcaaatgtatcaaaatcaagcaggccgccgataatcgcgacatcagtgccgtgacccttatacgtctccgcaaatgatccgtaaaaagacacaacgattcggcggggctcccgcctgaataagcttctggccactctgccgatccgggcggcgcctgcggtatgtgaactggacggaccgatcattaccgggccgataatatcaaaaacgcttctatacttcatgctggtttgttcctccttaacatcactttattcagcgcttttctttagactaattgaacatttctcaattggcaagcaggcacactgccgcactgccgcaggtaaataaaggcataagaatagaagggcctgataagcccttctattctgccgcaaatatatatggatacagaggctgtctgccgttatggatttcaacctcgatatcttcacagacgcttgcaatatactcagcgagtttctcagcttcttcttccggcgcgtcctctccgtacaggatggtgatgatttcatcttcatccccgatcatttcatccagcagcaatttcgccgcacttatccgatcttcggcgctgccgataattgaactgtttaaaatgccgataaaatcaccttttttaatatctttgccgtcgatatgggtgtctctgactgaatatgtcacctgtccgcttttcacattccggatggcctcaagcatattggcttcatttacgtcagccggctggtcagggttaaacgcaagcagggcggtcatgccttgagggaccgtttttgccggaatgacaatgacattttcttcagccacgctcgccgcctgattggcagccatcacaatattggaattgttcggaagaatgaaaaccgtctccgcattgacagactgaacggcttcaacaatatcttccgtgctcggattcattgtctggccgccttcgattacgtgtgaagcgccgatgctcgtaaacaattcagaaatgccctctcccattgccacagtcacgatgccaaaaggcttgcgggcttctttcataacgccggccggctttttttcatcatgttcttggctgatgattgaagtatgctgttccctcatgttttcaattttaattttaatcaaatcgccgtaacgctgtgcgagattgagtacgttccctggttcttcggcatgaatatgaactttcgccagcgtgtcatcagccacgaccagcaatgaatcgccgaaacggctcagttcgtttctgaacgtctcttccttgaacgtccgtttatcttgatccagccttaccatcacttccgtacaaaatccgaattcaatgtcttctgtactcagcatgctctgcgcgcttttatgatgctcggcattcaccatatcatcgagtgccggaagaaccgcttttttcggtacggcctctccttttaaagcagccaaaaagccttcatatacacaaagcagaccttttccgccgctgtcaacgacaccgacgtcctttaaaacaggaagcagatccggcgtgcggttcagcgacgcttccgcttcttcaataacggcctccatgaccgaaataatatcggtttcttctttggccgaggcgaccgcttttttagccgcatccttggccacggttaaaatcgttccttcaaccggtttcatgaccgccttatatgccatatccactcccgcttggagtgctgcggcaaattcttgggcgtctatttggtttttgttttcaatgctctttgtgaaacctctgaacaattgggacaagatcacccctgagtttcctctcgctcccataagcaggccttttgacaaggcgatgccgactttgccgatgtcgggtgagtcaatgtgctctacctctcttgcaccggatgacatcgataaattcatatttgttccggtgtcgccgtcaggcacgggaaacacgttcagcgcatccaccgcggatgcgttttgagacaatgtctcagcccccgccagaatcattgccgcaaaagctctcccatctaagtttcgtctagacaatactcatcctcctcactacgggttcgttactcgtacgccttggacataaatatttacagaatcaactgcaagtccgattgtttgatttactgtgtattttaccttcgtctgaacattgtgggctacttcggatattttagtgccgtagctgacaataatgtacatgtcgatatgtatttgttcggcttcctgacggacatgtacgccttttgcgaagttctctctccggaggatttcagacaaaccgtctttaatctggttttttgaggccatccccactattccgtaacagtcaatggcagcgcctccggcaaccattgcgatgacttcgttggatatatcaatctgtccgtattttgtcttcatttcaatggacacacaggttcctccttcagatgcatagagttatcattattctactatatgtatcccattatgaaaagaaaagatacagacagcggccttcagcgcggaaatgtgattggttttacatgtcaagtgatttttcttgaaagtaagggaaacaatagttgcaaacggtttttagctgtggtaaattatttaaagtattgtataacgaaagcatctgagacactatgtttgaaaagatgtttcgcgcagttaggagggaaacaaatggcacgtaaatgttttattacaggtaaaaaaacaaaagccggaaacaaccgttctcacgcaatgaacgcttctaagcgtacttggggcgccaaccttcaaaaggtccgcatcctcgttgacggcaaacctaaaaaagtatatgtatctgcccgggctttaaaatccggtaaagttgagcgtgtataagcaaaaatgaacgcctgcccttttatgcggcaggcgttttttatgcgttcaaagagggcaatttcagcttcttgggcttactcttttctaaatgagcccagcatcgcccggacaattcctcctaaaaacttcggcaatttaatggtataaaatttcattttgtcccctcctataagtcccgtatccgctgcgttcatcactttaggattcatggttttttccgcatatggcagaagccgcttttctaatccgcgctccttaccattattaatatgccttttgcaaacgaaaaagtacctcgtgaatgaatgagttcgttactaatacatagtgtggaacccagaggaatatgacaattatcaaggggatatttaaaaccgtcgagtgtcaggccgtctgccgcttccgtaaacggaatgaaagaaatatagcgtctgcgcactttttcttcaattgtataacggccgggcccgaacatctgaatgtcattctgccggtcgatcagctcgacatcggtattcttatgtaaggctttatacagcagctggatattccctaaaaagtgatcggctcttccgcccgtcacaccgaatatccgaatgttttccggttctttttgtaaagcccagtcaagggcgagttcaagatcggtataatctttttccgcctgatacacatggagggccggcgctgctttttgaatctgcatgagctcctcttccgtaatgctgtcaaaatcaccgaaagcttcctgcggaatgattccggcctccaaaagagcaaccgtccctttatcgactccgacccacgtcgtatctccgtctgtgtattcggatagatcgggaataagctcccgcgggcctcccgcaacgatattgattgtattcatatgttatcctctctcttagacgcgaaaagagccggcggctttcaccgggctctttttcagcatgtttatgatgcgtttcggatgtcagcgatggcttttttccgatccggctgattatatacggcagacccggcaacaagcagattggcgcccgcttcagcgcataaaggggctgtttctttattaacgcctccgtccacctcgattaaaagctcagacaggcctttctcctcagccagctgtttgacctgacggattttcggcagaaccgaatgaatgaagcgctgtccgccaaaaccggggttaaccgtcattaacagcacaaggtcaagctcctcgatcacatgttcaatcgtttggacgggcgtatgcggattgagcacaactcccgcttttactccctgctcttttatcaattgaatggtccggtgaagatgcggacacgcttcagcatgaacggaaaggatgtccgcaccggcttttgcgaatgccgggatgtagcggtccgggttttcaatcataagatggacatccagcggcagatcagtcaccggacggacggcttcaacgataagcggcccgattgtaatgttagggacgaaatggccatccatgacatcaatatggatatagtccgcccctcctttttccacgtctttaatttcctcgcccagtgaagcaaaatcggcggaaagaattgatggcgcaaccttaatcatattaatacctcggctttctctcttttatttcctgcataaattctttgtaatgctcatagcggtacggctgaatctctccttcttccaccgcttgctttaccgcgcatttcggctctttaagatgcagacagcctctgaatttgcaagaggcgcttatttctctgatctcagggaacgtgctgcccagctcttcttcctcaatgccggtaaattcaagcgaactgaaccccggagtatccgcaaccagaccgcctgatgtatgaatgagctccacatggcgcgtcgtatgttttccgcgtcccaaatgcgcggaaatctcgtttgttttcagctcaagctccgggctgatcgcatttaaaagcgaagattttccgactccggactgaccggcaaacaccgtcgttttgttctcgaagtgtttcacaatgcctgttaagccgctgttttcttttgatgacgtcacatatacgtcataaccgatcgcctgatagtctttcacgtaagaaagtatcgcctctttcgattccccgtctgcagctaagtccattttggttatgcagatgatcgggtgaatgccgttggcttccacaaggacgagaaaacggtccaataaagacgtgctgaacgccggctgaacggcagaaaagacaagaacggcctgatcgacatttgaaatcggcggcctgatcagctcgtttgttcgttctttgatttccagcaggtagccttctttatcattttcagcctgataaacggcataatcgccgaccaggggcgttattttattttttctgaaaatgccccggcccctgcattgaatgatcttgtcctgtgattcatccaagacataatagaatccgcttaacgcttttataattttgccctcaggcatagggtccctccttgtcagtcattatctttcgggtattcaatcgttttgtagctgacgactttatgatcgaccatcacttgataataccccttctgtccctgatcaatcttcagttcaattgttttttcagtcggctcttttattttaaatgagtcatacgtatcagagatgctgtggtccttatcatcgatggcgatttgcacttcaagctcgtccccttcatgttcgggttcgtaaggaatgctgattttttcttttaccgttttcgccggtttttcttcaggtccgagcgagaacgtcacttcaacattacttcccggcttaaccgcagtgccggctgccggctcttgcttcatgacttgtccttccggcacgtcatctgaatgggcttgtttttcaacaagctgcaggccgttatcttcaagataccctgaagccgcttctttgctgtaagtctttaagtccctcagcgtaacgtccgccgggccgaggctgaccgttagattgacttcatcgtcgcttgcaaccatgtcggtgccggctgacgggttctgatcaattacggtgccggcctcgctgtcatcgttctcttctttgacattgacatgtttgaagcctttttccttcagcgctttttttgcgtcgccgatctgccgccctttcacgtcgatcagctgggttttcggttttccgatgcttttgtacagttttacagaagagctttctttaacggtagaccccgcttttgggtccgttttgaccattaattcctcttctattttttcatcttcaatatccgttatatcaggatccgcccggagcccgttcttttcaagcagggcttccgctttttcgtacttcatgccccgtacatcggggacgcttacatctttaggcataaataaagacggaaacacggtgaccgcaagaacagctgccataatgaaaatgaaacagacggccagcaaaacccacggccatttccgttttttctttttggcgggctgctgttccttatcatccgtctcccccggcgtctccgcctgaggcgcggcttttgtgccgtcagtaataacgggaatggcttttgtcatttcctcatcatcctgcacggaaaatttttgttcattcagcctgccggcgtcaaaagccgttctgatgtccgcttccatgtcctcggcgctttcatagcggtgaaacgggtctttagcggttgcctttaaaataatgttttcgacgctctgcggaatggaagggttccactttctggcggaaggcgtttctgtttgcagatgctttagcgctatactgacggctgattctccgtcaaaaggaattttacctgttaaaagctcaaacagcacgatgccgagcgcgtaaatatctgattttttcgttgccagaccgcctctcgcctgctccggagacaaataatgaaccgagcccagcacagaattcgtatgtgtgattgtcgtagacgtaagcgctgtggcgatgccgaaatccgtcaccttgatatgccctaaatgatctatcaatatattgtgcggtttaatatcccggtgcacgatatggttttgatgggcatgggcgatggccgagacgatctgctccataacggacagcgcttctttcggatgaagcggtccgtgtgcttttatgtattcctttaatgtcatgccttccacatattccatgacaatgtaataaatatcgccttcctccccgatatcgtaaatactgacgatattcggatgatcgaggcttgatgccgactgtgcttctcttctgaaacgcctgataaaatcaatgtcattcacaaagtcaaaccgcagaattttaattgcgacttcacgttcgagaatgatgtcctcagctaaaaaaacgtttgccattccgccgccgccaatgggccgaaggatatgataacgcccgctgatccgcttgccggttagcacttgtcttcaccctcttttgcatctgcggaaaactcaatcaacacagccgtgatgttatcttcgccgccgttttgattcgctttgctgatgagaaggtctactttttcctgaggatcagattcggcttgaagcatttgtttgatctcgtgatcttctattttatttgacagtccgtcagagcataaaagcagctgatcgccgtcagacagttcaaaagaacgggcgtcgggactgatggtttcatctgtccccagcgctctcgtcaatacatttttccgcggatggtgctcggcgtcctctttcgaaatttcccccgtcttgaccagctcattcacaagcgaatggtcttcagtcagctgagtgaattccccctcttgaagcaggtagcaccggctgtcaccgatatgagccacagtgacaaacttcccggtgaataaggcgcaaacaacagtggtgcccattccccggcattcttcattcgctttagcgtggtcatgtactttgacattcgcctcatgaatccggtctttcagccaatcctcgcaagcagacggcagagaaggaaccgtttcggtccggttccactgctcttccatcgccgcaaccgccatcctgctcgctacatctccggcaagatgaccgcccatgccgtcggcgacaaccgcaagcaccgcgtcttcttttgtgaaaatgcccgccgcatcttcattatgccggcggactttacctgtatctgttttcaaggctgtaatcaacctcttcacctcgtctcgtcttgacgctccttcgcgcgaagctgaccgcaggccgcgtcaatgtcatggccttgctctcttctgatcgtgacatttacaccgcgggattttaacgttttttcgaatgcgaaaatctgatctctcggtgtgcggacgtaatcccgttcaggcacatagtttaccggaattaaattgacatggcatttcacgtcttttaacagttctgcaagctcttctgcatgttcgacctgatcatttacgccaccgaacagcccgtattcaaagctgatccgtctgcctgttttctcgatgtaatatttgacggcctccataaggtcaggaagcttataggctttgttaatcggcatcagacggcttctgatttccgtattcggagcatgcagagaaatcgcgaaattgatctgcattttttgatcggcgaaatcgtaaatcttcggaatgattccgctggtggaaactgtgatatgacgcgctccgatgttcagccctttatcgtggttaatgatttttaagaaagcgagcatttcattgaaattatcaaacggctctccgattcccatgatgacgactgagctgacgcgttcatccgtttcatcaagcgccttttgcactttcacgacttgagcgacgatttctcccgcttcaagattccgtttcagtccgccgagcgttgacgcgcaaaatgtgcagccgatccggcagccgacctgtgtcgttacacatacagaattaccatactcgtgtctcattaaaaccgtttcgatcgtataaccgtcatgaagctcaaataaaaatttcatcgtgccgtcttgagatgtctgttttacagccgttttcagcgttgtcagcacaaaattgctctcgagtttttcacgcaggctttttgagaggtttgtcatttcatcaaatgaagaaacccgcttctcataaagccattcaaaaatctgtgctgcgcggaacggcttttcgccattctcggtcagccattgtttgatttcatctaattcaaaagagtaaatggacggctgctcagtccgcagctctttccgtacgcttgtcttttttaattgtgtcattttttatcccttctttctcatgctgctaataaagaaaccgtctgttccgaaataatgcggaagaatttgaaggcttccatcctgaacaaagggtctcgccttttcaggcagccgcttttcaagagacaaatcgggttcaaactcagggtgttcttgtataaacgcatgcataacttcttcattttctgtccggtccattgtacacgtactgtatacgagtgtgccacctttttttactaatggggcgatttcccttaaaatgccgagctggatttctgacagccgtctgctgtcctccggcgtcttcgtatatttcatatcgggttttcttctgatgacgccgaaacctgagcaaggggcatcaacgagaacacggtcaaaccgttctgcgccaaaggcctctcccgcttttcgcgcatccatcgtttgcgcgtcgatgatcgtaagcccgagccgttctgcgccctctttaatcagcttcactttatggcggtgaagatcaagcgatgtgaggctcccctcgttctccatcagttccgcaatgtgagccgactttccgcccggtgcggcgcatgcgtctaaaacggtttcgcccggcttcgggtccagcgcccgcgcgacaagcattgagctttcatcctgtatggatacccggccgttttggaaaaatgccgtgttcgcgatgcttccttttaaaagcttaatcgcatcaggagaaaggtctccggcttcagcttcaagaccggcattctccatctcattcagcaccgtttccctgtcgctctttatgtgattgacacggagcgtctgcttcggcggaatgagatgaatccggcagatctgttcagctgcctcaaagccgtacgcctcgacccactcttttacgagccactcgggatggcttgtctctgtggaaagacggagaaccgggtcttcaatttcagcgaatgacggcgccccttcacgctgcagggagcggaggatgccgttgacaaaggacgcaatgcccttatgcccgcgttttttggcgatctcaaccgcttcatgaatggcggcgcgatccggtattttttctaaatactccatttgatacgcggacagacgaagcagctgaatcacccatggcttcactttattcggcttgcggataaaaggcttcagcatgtagtctaaggcgattttattttgcagcgttccgtagacaagctctgtcagcagtcctctgtcctgatcgctgagcgtgttcgttttgataaccgatgtaagaagcaggttgctgtatgcctgattttgctcaagcttctcaagcgcttcaagggcgagctcccggacattaattttcttcatttgcttctcctaatacgtcaccgggctgcacatttttgcctcttacaaaatcttcgcccttcatccgtttttttcccgccggctgcagctctgtgattaaaagggcggtgctgtttcctgatgcggcgacaatgccgttttgctccgtgcggatgactgttccgggcgcagcttcagtttttgccgcaactttttcagaagcccatactttcatattttgaccgttcaaagttgtataggcgacaggccaagggtttaaacctctgatctggttgtagatctcttctccgggctttgcccaatcaatccgctcctgctcacgcttaatgttaggcgcgtaagtcgcttttgattcgtcctgtttgatcggtttaatatttccggaaatgacgttcgggacggtctctgacaaaagcttcgcccccgctatgcttaatttgtcgtgaagcgtgccgacgttatccgtttcatcaatttccacttcgattttcgaaatcatatcgcccgcatcaagcttttcaaccatatacatgattgtcacgcccgttttcttcttgccttggagaatcgaataatgtatcggcgctccgcctcttaattcaggcaatagtgacgcgtgtacgttgatacagccgtatttcgggccgtccagcagctgcttgggcaggatctgtccgaatgccgccgtaacaatcaggtccggcttcaggctgagcactttttctatttcttcttcgagccttactttttcgggctgaagcacgggaatgccgtgacgttcagcttcagcctttacaggagggggcgtcatgattttttttctgcctttcgggcggtcaggctgcgtaacgacaccaaccacttcatacccgtcttcaataagcgtgcgcaggacgggaactgaaaaatcgggcgttcccataaaaacgatccttgtcatccaatcatccttccatttctgccagttcttcttcagtatagtaagccgtaatttttgatgtgaataaaatgccgtctaaatgatccatttcatgctgaacggctctggccaaaaaaccctccgcttctaaaataaacggttttcctttacggttataggcttttacctttacgtaatccgggcgggtgacatcgccgtaaaccccgggaaagcttaagcagccctcgactccggtctgttcaccgctcttttcaagaataaccggatttacaaggtcgatccggccgctttcttcaccgatgtccacgacggccgctctttttaaaatgccgatttgcggcgcggcgaggccgacgccatccatttcgagcatcgtatcgtacatatcgtcaagcagtttttttaattttttatcaaacactgtcacttcatcggctggtgtttccagaacctccgccggatgtgtgacgatttttttcacagccaaaattttgccctccaaaaactaatgttacatcagcatgtacggattcatatcgattgaaatcatgacatgcttttgcgcaatgtcgcgtttatagtgctccagtatctttttcaactgaatctgcaactcgttttcctgtctgtattttatcacgcattgatagcgatatctatctttgatcctggcgatcggggaagccgccggcccgagaattttcgtatcaggcccgcatcccgctcttaaatagtttgtaatcttttctgcggtgaccgcggcttttgccgcttcttcatgagaaacggtcaccagcgccacgtaataataaggcgggtatgactgggcccgtctgtgcgccatttcctgctgaaaaaaagtttcatagtcatgcgttttcgtcagctgaatgctgtaatgagacggtgtatacgtttgaatgaccaccgttcccggcttttcatgccgcccggcccgtccgcttacctgcgtcagcagctggaatgtcttctccgcggccctgaaatcagggatgtgaagcgtcgtatctgcgcttaatactccgacgagcgtcacgttcggaaaatcaagcccttttgcgatcatttgcgtgccgagcaggatatccgccttcccttcaccgaacgctgacaacagtttttcatgggcgccttttcttgaagtggtgtccacatccatcctgatcacgcgcgcctgaggcagcactttggtaagctcctcctccacacgctgcgtgcccgtgccgaaaaagcggatatgttcgctgccgcattccgggcatgttcccgggacaggttcctcatggccgcagtaatggcatttcagcctttgtccgtagcggtgataagtcattgaaatgtcgcaatgcggacattgcggcacataaccgcagtcccggcacatcacaaacgaggaatacccccgtttattcagaaaaaggacggcctgctctttttttgcaagcttctcttccagctgttccatcagctctcttgaaaacattgatctgttgccgtttctcagttcttctctcatatcaacgagagaaacgtcaggcatgagctggcgatttacgcgatgttttaatggaagcagctcataaacgccttttttcgcccgcgcaaatgactccaatgtcggcgtggcgctcccgaggacgaccggacagctgtgatgctcggcccggcggatggctacgtcctttgcatgataccgcggcatttcctcctgcttataggaagattcgtgctcttcatcaataatgatcatgccgagattttcaaacggggcaaagatggccgatctggctccgacgacaagccggacttccttgcgctgaatcttccgccattcatcgtatttttcacctgtggataatccgctgtgcatgaccgcaacctgtgagccgaagcggcctttaaaacggttgaccatttgcggtgtcaacgagatttccggaacgagcacgatggcttcttgtccttttgccagcactttttcaatggattgcaggtaaatttccgttttgccgcttcccgtgacgccgtgaagcagaaagacgtgatggacatgatcggctacagcttgtttaatcggctcaaaagcggcctgctgctcttctgtaagagagagcggctctgtttttttgaacattctgtcctgataaggatcgcggtaaacctcctcaaagctttccgtaagaagcccctttttaagaagcgttttcagcgtcgcggaactggaatcggtctttttgcaaagctcggccgcggaaatctttgctcccccgccgataaaataagtaagcacggcgagctgtttagaagcctgctttgtcaatgaatctgcgtgccgggcgagttcttctttgtccgcccccgcttcgatcatgcggatcatttttttattcgttttttgggcgactttatatgtgacatcaatgcttcctttgcgcacgaatttttgaagtgacgaaagaatgctttcatcggtaatatccgagtacagaagacttttttgattcctgaaaagctgtttgatgtccggtgtcagcgcttcttcgtcaacgactttcagctctttctcgtacttcgccttcagtgcggcgggcagcattgcctgaagcgccgtgattttaaacgacagcgttttgtcagaaagccatgaagacagctgcatcagttcctcagtcagaacgggcgtcaaatcaagaagcttctcgacttccttcattgagccgccgtttaattcagacgaatctttcaaaccggtcacaaatccttgaagcttgcgcgggccaaacgggacaatcacccgcatgccgacttcgatcatcccttttaaatgatcgggaattttgtaatcaaagggtctgtcaatgtttttggagctgacatcgacaatgacttctgctacattcatacgggttttcggtcctcggctttcaaagcggtcatttccttcagcatttcaaaggaaacgtcaagtttagacataagcgcaagctcccgttttcttccgtcccggaaatagaaggtgacgacattcgtatccgtgccaaatccggccccttctgctttcacatcatttgcaacgatcatatcaaggtttttctgttcaagttttctgcgcgcatagcgttcgacgtcttgcgtttcagccgcaaatccgaccagcagctggtgtgttttccgttcgccgagttctttcagtatgtctgccgtacggttgaattcgatcacgagcgaaccgtctttcttcttcattttgtgatcagaaacagccgccggcgtaaaatcggccacggccgccgtcttaatcaccatgtcgcatgaatcaaacacagaaaacacggcttctctcatatcagctgccgattgcacaggaagaaactgatacagcccgactggcggctctattgacaccgggcctgaaatcagcgtgacccgcgccccgagacagacggcggcttcagcagcggcgtagcccattttgccggtggatttatttgtgaagaagcggacagggtccacggcttcgcgcgtcggaccggccgtaatgacaatatgttttcctttcagcggcgcatcgtcttcaggctccttaaaatgctctctgacacgctcaacaataagctccggctcctccagccttcctttgccgacatatccgcatgccaaatagccttcactcggctcgataaagcggaccccgtcctgataaagcacagagatgttccgtttcaccgccggatgatcatacatatggacattcatcgcaggcgccacccaaaccggggcctcagccgccagcaccgtcgttgtgagcatatcgtcagcaattccgttggcaagcttgccgatgatatttgccgtagcgggcgcgacaataattaaatccgcccagtcagcggcatcaatatgagatatcaccttcggattttgttcattaaatgtatctgtatatacttcattccggctcagcgcctgaaatgtcagcggagaaacaaactcacgcgcggactcagtcataatcactttgacgtttgcgccggcctgaaccagcttgctcgtgagtgcggaagctttataaacggcaattcctccgcttacgcatagcaaaatgtttcggtttttcatgaagtcttctcccctttatgaaagcattggacaaatcccaaacggaaaaaaataacaacctatgtagagataggttgctacgtgtgcttgttattcgctgtcttctctttcaaacgaaagcaggcccgcgtctatttcttctaaagctttgcctacatatttgtgagaaatggtatgttcaatctgctggtcttttttgatctgcatttcacgcgcgcgtcttgcagacacggtcaccagcgtatatttagaatctaatttattcattaaagagtcaattgacggatctaacataagttattctacctccagcattttcttatatctcggagcgacgcgttcacgttttaagtgctcggcgagaacgattgcgttaatcttatcacaagccgtttggatatcgtcgttttcaacgacataatcatacgcgtccatcatttcgatttcagcttttgcggcattcattctgttttcgattaaatcgtcggtttcagtccctcttgtcacgattctgtttttcagctcagaaagactcggcggcgctaagaagataaacaggccttccggaaatgcattccgcacttggagcgcgccctgcacttcaatctctaagaagacgtcttttccttcttgaagcgtctgttcgacataatcaacgggcgttccgtaatagttgccgacatattctgcccactcaagcagtttgttgttttcaatcatgcgttcgaattcatctctagatttaaagaaataatcgacgccatcgacttcgccctctctcgggtttctcgtcgtgactgaaattgagtattcaaatttcgtgtcctgttgtgaaaatattgcttgccgaaccgttccttttccaactccggagggacctgagagaacgattaataaccctctttctttcatgcggcaattacccctgcccttcatccataatttcttctttcacagaaagtctgtgtgcaactgtctcaggctggacggcagataagataatgtgatcactatccatgacgacaactgcacgggttcttcgtccgtatgtagcgtctattagcattccgcggtctcttgcatcctggatcattcgctttattggcgcagactccgggctgacaatcgaaatcatccgattggcggagatgatattgccaaatccgatattaatcagtttaatcgtcatcttctacgttccccctgtaaaatagacgtctctagtgtaacctgaagaggccgtctgtaaacaatacgcacagtcgctattctatattttgcacttgttccttcaatttttcaatagaacttttcatttcaacgacaagctttgtgatttgatgatcattggcttttgagccgatcgtgttcgcttcccggttaagctcctgaacaaggaaatcaagtttgcggccgactgccccgccttcttttaatatatcacggaattgaacaaaatggctcttcaacctggtaatttcttccgttatatcagaacgatcggcgaaaatggcgcattccgtgatcagcctgctttcgtcgagcgcatcctccgtccattccttcattcgggcgtaaagacgctcgcggtattgaataacaacggccgaagcgcgctctttcacctgttcggacagcgtctcaagccgctcaatgtgcagaaagcagtcttccgccaaaagccgtccttctttttccctcatgtcacaaagttcctttacagccagctcagcggcttccctgatgacttcttcaagcttgtcatcacgcatttgttcttcgtgtatctgcgcaatatgttcaaatttaaagaactccattgcatcgggttctgcggccaggctgtagcgctctttcatgacgcgtgcggcgctcacatattcatcaaggagctcccaatcgatgttcaggcttctttttatgagcgcgtcactgtttacagtgagaaacagctctactcttccgcgctgtatatgctgcaatatcgtttgtttcagcttatcctctacatatagcaaaggccgtggcaggcgggcgttcacttctttgaaccggtaattgacggatttcaattcaacggttgccgagagatcgccttttgtgctgcttgcgctgccgaagcctgtcatactccgtatcatatgaaacacccaattctttcccgttatcaaaataaaagggcaatagacatgctattacccctaagattatatcatatggaattatttttttcttgtcaaaagtgaacccgccagcaaaaaagtaggtatgcccgacataccgataatcagcatccaatcgcccggcgtaatcggcactgttttgaaaatcggctgcagcggcggataatagatgacgatgaccatcaggaagatagaagaaatgatggccccgagcagatagatattttcaaacggattccgggagaaaacagacgtttcgctccggcagtcaaacacgtgtataagctgagccaggacaagagtcgcgaatgcaacggtctgtgcgtagggcagattttcaggattgcggtgatagacgatgataaacgctaaaatggttgcagctccgattaaaaaccctcttgatacgactttccagcccagttttctcgcaaacactccttctttcgggtgccgcggcttccgcctcatcaggtctccttccggctgatccataccgagggccatcgccggcagcccgtcagtgactaagttcacccacagtatctgaatcggaacgagcggcagcggcagagcgagaagcatcgcaaacagcatcactaaaatttcaccgacgttggaggcgagcaaataccggacgaattttcttatattttcatagatattccgtccctcttttatggctgatttaatcgtagcaaagttatcatctaccagaatgagagaagaggcttcctttgccacatccgttcccgtcacgcccatggcaacgccgatatctgcctgctttatggccggcgcgtcattaaccccgtctcccgtcatggcgacgacgtgtccgttttcctggaacgctttgacgatttttaatttatgttcaggcgacacacgtgcgaagacgtagacatcatcgaccgtttcgataagttctttctccgtaagctcattcagcgtcttcccgtccatcacacgcccctttttcggaagaagacgcaaatctttcgcaatggcctttgccgtttcgacgtgatcccctgtgatcataaccgttttaatgccggcttcacggcattctttaatcgcctgtctgacctccggacggggcggatcaattatgcctgacaagccgagcatcgtcagatttttttccgcctgctccattgtcggtttttctccgggcttaagcggtttataagcaatcccgatcgtacgcaaagcttgcgacgccagctctttcagaaccgcttccgtttctgctttcttttctccagaaaatggcgcgcttcttgcgtcgtacatcagatgtgacgagcggtcaatcagcacatcgggcgctcctttagtgatgacgaactgctttttttcctgatcctctacaatgacggtcatcattttgcggacggagtcaaacggaaactcggcaaccacgcggtagtgcccgctgagccaatcgtttgaatagccgccctttcttgcagccgtcagcagcgctccttctgtcggatcgccgtcgagtacataatggccgtctttcagtgcgatttcggatgtgttgcacaacgcgccgaaaaccagcatctgttcaagaatcttctcatctttcggcttgatttcccgctcatctcgggtgaaaacgccctccggctcatagccgatgcctgacactttaaatgtttttccccctgaccacatatgggtgacggtcattttgttttgtgtcagcgtgccggttttatcagaacaaatgacagaggcgcagcccaatgtttcaaccgccgggagctttctgacaattgatttttgtttgatcatgcgctggacgccgattgataatgccaccgtaacaatggcgggaagcccttccggaatcgcggcgacggccaatgacaccccggccaaaaacatgctgtaaagctcatgtccctgtaagacgccgactgcaacgaccaataccgttaaaaggagcgcgacgataattaaaattttgccgagctcttcaagtcttcgctgcagcggtgttgaaaggctgccggcggattccagcatatcggcgattttccccattgccgtattcattcctgtaccgacgacgacgccgacaccgctgccgcgcgttacgatcgtacccataaacgccatattgctgatgtcgcctaacgaaacatccggctttctcagtttatcagcttgtttaaccaccggaattgattccccggtcagcgccgattcctcaatttcaaggcttttcgcttcaacgatccgcacatccgcgccaatccggtcgccgcttgaaaatttcatgatatcgccgggaacgagctccttggactgaattttcttccagctcccgtcccgcaacgctgacacatacggcgttgacagctcttttaatgcatgtaaagacttttccgcccgccgctcttgaaaaaaaccgagaaccccattgacaaatacaatcgccataatcgctacggcatctacatattcgcctaaaaacccggatattaaggttgccgccagcagcacgagcaccataaaatctttaaattgggcgaaaaacacggcgatcgccggtgtcctcttgccctcctgaagctcgttcggtccgtgcttttcaaggcgttttttcacctctttttcggtcaacccctgtttaatggacgtatttgttgctttcagcaaatcggtttgtcccatttcatgaaacttcattcttctcgtccactcccctgcctcgctttagagatgtcactctgtaaacaagcttattctgactcgtcccttttcatgctataattatcgaatgcaggaagaaggaaagggtgttttatatgtcttttgatggcatgtttacatacggaatgacacatgaattaaacagccggatcgccggaggccggattacgagagtccatcagccttttaagcacgatgtgatatttcatatccgcgctaacggaaaaaaccataaattattattatcggcgcatccgagctattcacgggtgcacatgacaaaccaggcctatgaaaatccgagcgagccgccgatgttttgtatgctgctcagaaagcatatcgaaggcggatttattgagaaaatagaacaggccggattagaccggattatgatattccgcataaaaagcagaaatgaaatcggcgacgaaaccgtcagaacgctgtatgttgaaattatggggcggcacagcaatattattctgactgacggagaaggagccatcatcgacgggctgaaacatttatctccgtcgatgaacagctaccggaccgttctgccgggatatgattacaagcttcctcccgctcaggaaaaaatttcgccgcttgccgcggatgaagaggacgttttgcgttatctcagttttcaggaaggacggcttgaccagcagatcgtcagacatttctccggtgtttctccgctgtttgcaaaagaagccgtgcacagagcgggcctcgctaacaaaataacgctgccgaagacgctgattgaaatgttccatgccgtgaaagattgcaggtttacaccgaacattacgacagccggcggaaaggaatacttttatctcctgtctctcacacatgtaaacggagaggagcgcacctttcactcactgagtgagctgttggaccggttttatttcggcaaggcggaacgcgaccgcgtcaaacagcaggctcaggatcttgagcggtttgtcgcaaatgaacggaaaaagaacgccaataagataaaaaagctggaaaagacgctcgactactcagagaatgcgaaggaattccagctatacggcgaactgctgacggcaaatttgtatatgctgaaaaaaggtgacaaagaagcggaagtcatcaattattatgatgaagaaagtaagacggtgaccatccctttaaatccgaacaaaacaccgtcagaaaacgcgcagatgtattttacaaagtaccaaaaggcgaagaattccgtcgaggtggtaaaagaacagatccgtctggccgaggaggaaatcgcttatttcgatcagctgatccagcagctctcctccgcctccacaaaggatattcacgaaataagggaagagcttgtggaaggcaaatatctgcgaccgaaacagcagcgaggacagaaaaaacagaagcagcacgttcctgttttggaacaatatgaatcttcacggggattgacgattcttgtcggcaaaaacaataaacaaaatgagtacttaacgacaaaagctgccgcaagggatgatttatggttccacacgaaagacattcccggttcccacgttgtgattaaaagcagcgatccggatgaacaatccatactggaggcggctgcgatcgccgcttatttttccaaggcgaaagattccggctccgttcccgttgattatacaaaaatcagacacgtgaaaaagccaaacggcgcaaagcccggatttgtcacctatgacagccagcataccgtatttgtcacacctgatgccgaccttgtcatacggctgaaaaaataaacacacctccaagctgaaatccgcactcagcttggaggtgttttttcttacgtataaacggagacgacactctcccagccatcagaaccgatctttacaatatctgatcagtttcccgtcatgtctgcctgatccgccggggaccgtcctctgattaaagcggtcacacctgatttggcggcggatactatcaccttccctcgtcaaacctgaacacatccggcccagttaatataatcatgccgggtctctgacctttcctttgtatgcgggcggaatccaggcggcattgggatcagatacatattccgcgtcacttcgcaatcctgaccgcttgccggcatataccgttcaaactgcccgctttcgttttgaattgttcacaatcggggactgtcaggacagtataaaaaacaccctgcctgagggactgccccccgtttttgagacaggggtcaaaacaccttttaaacagccaattgccgatagtttatcggtgattggttgtttagtttggtttgaatacgaatattgttataataatgaatgtattctatgacagtgcgttctacgatggcagtcgtagttcgatcaatgctgttaagatagaacgtttcagactttagcgaggaatgaaacgattcgatggaggcattatcagcgggcgtccctttgcgggacatgctcatggtaatgccttttgttttaacagctttttgatactcgtaagatgtatacacagaaccttggtcactatgtaacacgcagttctcaggcagcattggtagctgatcaagtgtgtctaagacaaaggctgtgtcctgcttatccccaatagtaaaagcaatcacttctccattgtataaatctaatatactggaaaggtacaattgtttctgtccataaggcaaatatgtgatgtccgttactagtttttcaagaggacgatcagactgaaagttccgatccaatatattatcgaccacggcatatggctgcccatccttcttgcgctttttcaccttaacccgacactgccattgatttttctgcataatacgttgaaccgttttatggttaatacacattctcttttttagtatggctgtgatttttcgatatccatatcgatacttgtgctctcggcacaacgtgccgatttgtttttccaaatggcgcttgggatgatccttcatcagattcttcttccaacgataataagacgctcgagagatacctaaatgaatacagatatcctgtacggtcattgtgctgtgcaatatttctacaagttcgactgacgtttcgctatcaacttcctttccaattcgttgtacttttttaaaacttcattctgttgtctcaggtaacgaatctctgcctgcagtttctctaaatcggaagaatactccggaccttttccgtaagtgtattgctttccaacaggctgttcgaatcgatgtgtatcaccagccttataccatctaacccatgtctgaacctgtgtcttattcttaatattcaactcctgcatgatctctttcataggtacgcctgccaatctcatttctacagccttctgtttcgcttcaaccggataactcactcttgtccccatagaaaaaacacctccaagtctaatttcggataacaatcatccgtattcaaacttgaaggtgtttttatttgtctcatcttatggggtcagtccctgatgacagacaaggtgttttttatggtcttcttcttttctcaaataatcgatccacttcttcagccaaatcagcagtaatgagatgctctatgtcctcagccagtcttttcgtatgtgccgggcttgcgccgcttgttgatacggatacttgaatgcgccctttgcggatgatcttcggcatatacacgctgccctgttcagcatcgcttacacaattgaccagctgcgtttcagaagcgctcgcggctatctcctgattcacgttgcggtcatttgtcgcggcaatgatgaaaaaagcgggcgcgagatccttcatttcaattttacgggaaacccagcggatgcgtccttcatccgccagctgtttaatttcgggcagggcatcgggactgattacagtaatatccgcgccttccggaagcaccgttttgagccttctaaaggcaacattgcctccgcccgcgatgataattctttttccgcttaaattaatgtgcagaggcagcatactgtccccccttaaaatcaaactgaccgccggggtttcgaacagcttctgacacacggttcaaaaacgcctgcttaatatgcgggtgaaaacctaagtatgaagcgagatgaacattttgattgaccgtttgaagcttttgaacttcccgttcaatctcagtcattaaaagcccggtaaacagaagatatggaacgttaaaaacgggtgctccgtcatcctcttcaaggccggcaaacacttctttatagtgcggatcacatgctgttaaaaaacaagggatgacttctttaacaggtgtaatcgcctcaagttttccggcaatctcactgactgcgttcttaactgccggatctgtgcttcctcttccgatcagcaccactttcgcctgctcaatgggcactccggtatcttcaatgcgatgatgcaccgcttttacgacttcatcgtccactccgatcggaacaccatatgtcacttttatatcgggatgcagggccgccgcacgggcgatttcagtcggaatgtcatgttttgcgtgggcagcggtcaacagcagtaaaggcacggccgcaatatgagtggcgccttgtctgacacatgcttcaaatcccgcttcaatagacggttcctgcagttctaaaaaacaaatttcctgaatgggagcgtcagcgtgcggcatgcacccttttaaaaacgccgccgactctgtctgcgcttttttcagcctgcttccgtgcccgatgtataaaatcgcctgcttcatttacaacgcctcgctcaaatccagatttttctgttcagatgcataccagtccagtttgcagtgataattgacgacatcgccgataacaattaagctcgggtttttgatttcttcttttatcactgtgtctgaaagcgtgccgacggtgcagacgactgttttttgcctgtccgtcgttccccaatgaataaaggctgccggggtgccggcgtctctgccgttttccagcagcattctttcaatctgccggatatttttaattcccatataaatcaccagcgtatcaatgcccgtcgccagcgctttccatttttcttcaaagtcgtcttcttgtttataatgtcccgtaacgaatgcgacattggagctcgcctctctgtgcgtcacgggaatgccggcataagcagcagccgcgattcctgatgtaatgccgggaacgatctcaaacggaatggcgttttgtgcgagagcctccgcttcttcgcctccgcggccgaaaacaaacgggtcgccccccttgagccttacaacggttttcccctttttcgcatacttcacaaggaaacggttaatcgtatcctgtttcataatgtgaaaatccgggagcttgccgcagtaaatcagatccgcttcttctccggcatactgtaaaatctctttgcttaccaatctgtcatataatataacgtccgctttctgtatggctttcattgccttcaccgttaataagtccggatctcccggaccggctccaacgataaatactttccccatagcatgtctccccgatccgttttgaaatcttcccagaacagccgcgaggccgcacttcagctattttaccatatcccgccattgcgggggatatccggctgattgcgcggcctttttggacctattatgctaagctgtttttcacaaagtcaaccagtcttccggtgcattcttcgcgttcacatttccctgaatcaagtacgagctcaggcgctttcggctcttcatacggcgagtcgatccccgtaaagaacggaatttcaccatttcttgcttttttatataaacctttcggatcgcgcttttcacatatatcgagatcgcatttcacgtagatttcattaaattcgccctctgccacaagctctctcacctgatctctgtcctcacggaacggagaaataaaagccgtgatgacgatggttccctgctgaacgaaaagcttcgccacttccccgatgcggcgtatattttccttgcggtcatcatcggaaaaacctaagtccttgtttaagccgtggcggatgttatcaccatcaagcacgatgacttgatagccttgttcaaacagctcgcgcgctgcggcgtttgcaatcgtggattttcctgaaccgcttaagcccgtcagccagaggatagagcttttatgcttgtttttctgctggtattcttctttcgttattgaggcttcatgccacacgatatcacgatttgtcactctattttcctccttaagaaacgcctgcttcttctttcgttttcagccctttaatcaacacctcgacaacttcaggacggctgaattccgccggcggcatgacgccgcttcgcagcatttctctgacctttgttcctgacagaatgacgtggtcttctctgtcatgcgggcatgttttggccgttcccatgttgccgcatttctggcagaagaagctgtgctcgaatttcatcggtgtaatcccgagttcatccgctgtaaattgatcaaacagctcttgcgcttcatatgtgccgtagtaatcaccgacgccggcatgatcgcggccgacgataaaatgcgtgcagccgtagtttttgcggacaagcgcgtggaaaatggcttctctcggccccgcataccgcatagccgccaaaaatacgccgaggaacacgcggtctttcggataataatgatcgagcagcacctggtagctttccattctgacatccgccggaatgtcatctgattttgtttcaccgacgagcgggttcaaaaacaggccgtcaaccgtctcaagcgcggttttttggatatattcgtgggcgcggtgaaccggatttctcgtttggaaaccgacgatggttttccagcccttttcttcgaagcttcgtcttgtatcggcaggttcaaatgtaaactcgggaaactgctttgacgcttttttaactaatgtgatcggcccgccgacatacgtatcgccgcgtgaaaataattttttcacgcccggatgcgcggcatcatcggttttatatacgtgaacggcttctttttgtttatccggcgtataaatatcttcgatgtcgactacgccgtatgtttctccgccgtaagtcagtttcaccgtgtcgccgacggcaagctcagccgctttatctgaatcgaccggaagcgtgatcggcagggaccagacaaccccggatgccagacgcatattttcaacgactgacacgtaatctttttctgtgaaaaatccttcaatcgggctgtaccccccgatcccgatcagctctaaatcagcgaacgaaatcaaatcaagctcaatttctttttggacggatgtaagatcatactgctcatttacccgattaattaatgttcctccgtgcggtgctaaactcataatacatgattcctcccagttaacagataaataaactcagattaatagttaaatgcctccgccttgttcatggacagagcgtttctcttttcggatggctttcatcagactggcggctccgccagctgccaaaagcacgctggccatcataaagatggaatagtaatctccttttaacagcagggagacaagcaaatacgaaatcgacagtgacaaaaacggtgaaacgacccatactttgagcatcgttttcacgacttctttatgaaaaacgttcggcccgtttttggccattccgataccgataattgatgatgatgtgacttgcgccaatgggaccggcagaccgaagacggaactgataatgacaagccccgcgccggttcctgaaagcagtatgccttctccggctgaaaatctcgtaatctttttcccgttggtttcaagcactttgcgtcctaaaagcagagcgccgagagcgacaaagatgcctccgtacagcgttcctttggacacgctgagcacgcccgcagcaaccaaagggcccaccgcatttgcgacattgttcattccggctgaaaaagcttcccaaaaccccgcaatcagcagcacaatccctaaaatcttctgtttccgactcgaaatgactcgaatattcagagaactgaataccttcgagacgagaaacgtgaaacagaacgcgacgaacggtacgagcacccaaaaaatcacgatgactaaaagatgctgtaaaaacaatactttgtacgcgacgccgacaccgacaatcgccccgacagtgacctcactcgtcgacagcggaatgccgagcacattcgccgtgaataatgatagcgccgccgatccgataataatgcagacaatggtgagcgaaatggtttgttcgggaatgattccgccgctgatcgtcttaacgacttcaccgccgccgataaccgcccctgacaggactccggccgcgcagatgatcagcgcatacgttttctttttaactgcgccggacccgtaagcgactcccattgaagccgcggctccgctggctccgatattcatggcaaaaaacaggcagaataaaatagcggctaattccatcgtgcagctcctttattcatgcagtccgcattctgttttcgccatgccgttccatctgccgctccgcaaatcttccgcggtaaacgcaggtgaagtgcacggttcacagccgatgctaggatacccctgatcgtggaggatattgtaatccagctcatgcttggaagtatatctccagatgtctttccatgtccaatggatcagcgggcatactttaatcgattgaaacttgtcgtctttattcaggaaattcgtattcgcccggctcggcccttgatcccggcgaaggccggacagccatgccggatgccctgcgagcgcttctcttaacggcagaatttttctgatgtagcagcactggttcggttctctttcccacagtttatctccgtgagcctcggcctgttcttcaagagtaaggcttggctttttcaggataatgttcagtcccgggtaacgctctttcactttttcgatcgtttcatatgtttctttaaagtgaagacccgtatcaagaaacacgatttccgcgtctttctttactttagaaattaaatcgatcaggacgatgccctcaatcccgaagctgcacgcgtaaacaagctggtctccgtagtggccgtatgcccattttaaaacggacagcgcgcctttataggaatcgtcttccggaaatgtaatcgccggctcttcccatgtgtcatacgttagcatttttcctttcctcctcccggagacaatcaatcagctgttgttttctgccggttgtcttatccctcaatctttttttcatataaaaaactttcaatccagcggaatgaaagacagtgacccggtatagcccttatcttcaaaatgctgtgcatttttctggatgcggcaccttgcatgacacgcaggttgccgggcgtcatcggtccagtccctcagccgctcttgataagctttttagatttgtactaaattttagcacaattctaacagaagtcaacccgagttttttgataggaataataaaacaggccctgaggcctgtttttattgtcattattttttaaaccaatcttttgactcgggattctgtttccatgatttcagtttctcaatgtcatctgaatgaatcgttccgttttcaagcgcgacttcaatcagcgtgtcataatccgttaacgagtaataaggaagacccgcttttttaaaggcttcttttgctttcggcagtccgtatgtaaaaatggaaatgacgccgaggacttccgcgccctctctttgaagggccgctgcagcttcaagcacgctgcctccggtagaaatcaagtcttcaatcacgactgttttttgcccttttttaatggcgccttctatttgatttcctttgccgtgcgctttcggtttgcttctgacgtagcacatcggtgcgcctgcacggtctgcgagaagcgcagcatgcggaatgcccgccgttgcagtacccgcgatcatctctgcctcgggaaaatgctctttcagcagtttgccgagcccgtccgccacatcatttctcacttttggatacgacaatgtcagacggttgtcacaatagatcggtgataaaatgccgctcgcccacgtaaacggctcattcgggcgtaaaaagacagcttcaatgtgtaatagatgttttgcgatagcctgtttcatcggcgaacgccctcccattccagtttaattgcttcatatgcttcaacggggttttccgcttttgtaattgagcggcccacgacgatggctgacgaaccgttttctttcgcaaatgacggagtcgccgtccggacttgatcgtcagctgcgtcactggccgtgcggatgcccggtgtgactgtcagaaatgaaggccggaccgcttcataaatggcttttgtttcatgtaccgaacataccactccgtccagcccgcactcttccgccattttgccgtaatgcacgaccgtttctaacagcggcttatgcagcagaagctcttccttcgccacctgctctgaagtgctggtcagctgagtcaccgcgattaaagacgggcgttttctgcctgccggcgtgccttcttcaagcccctcaagggccgcgcgcatcatgcgtgcgccccctgccgcatgcacattgacgagatcaacgccgaggccggccagccgcttcatcgctttattgaccgtagtcgggatatcatgaagctttaaatctaaaaatatatcacagttccgttcttttaattggtgaatgatggcggggccttcctgataaaaaagttccatcccggttttgacaaaaagcctttccttttcaaacaagtctaaaaacgttaaagtctcttcccctgatgcaaaatcaagcgcgatgatgggcaggttgtttttcatgtttccagctccttccgatgcattcacttacagattgaaagccgtgttggctcagtacacgggggagctgttctatgatttccgggcagacgaacggattgacgaagtttgccgtgccgacggcaaccgcactcgctcccgcaagaagaaattctaatgcatcctctgcggtctgaacgcctcccatcccgataatcgggatttgaacggcctggctgacttcgtataccatccggatggcgaccggtttgatcgccgggcctgacagtccgcccgttttatttgctaagatcggccgtcccgtcttgagatcgagcctcatcccgatgagtgtattaatcatcgtcagaccgtcagcaccggccgcttcaatcgctttggcaatttcggttatgtttgcgacattaggcgaaagcttcacatacacaggcactgcggaaacttctttcaccgcttttgtcagttcggccgccatgacgggatcagtaccaaaagcaatcccccccgttttgacattcggacatgaaatgttaacctcaagcgcatgcacattcggcgcttggctgatgtgctcggccacttctttatagtcgtccacctgagaaccggcgacatttgcgataatcggtgtgtcaaattgttcgagccaaggcagctcatggttgagcacatgctcaaggccgggattttgcagtccgatggcattcagcattcccgcgcttgtctccgccactctcggcgtcggatttccgaagcgggcttcgttcgtcgttgctttaatcataatgcctccgaggcatgataaatcgtaaaatccggcatattctttcccgaaaccgaaacatccggaagcggggatgatcgggtttttcaattggagacccggcagattcacctctaacattacagcgccacctcctcagctttaaataccggcccgtcaaggcagacctttacataggatgtatcgctttcacccgtacggcacacgcaggcgaagcaggctccgatgccgcagcccatccgctcttccatcgaaagataaacctctttatggccgtactgctgcttcagagctttcagcatcggtgtcggtccgcagcttagcaggacatcgaattcgagctgcttttcacggatgacatcggtgacaaaccctttctctccatatgtaccgtcagccgttgccacataggtgtctccgtacgcacgacattcctgttcgtaaaaaacatcctttgctgattgaaatccaagcacatgaatgacgtttacgcctttttccgtcaggcgctttgacagttcctgcaaaggcggaaccccgactccgcctccgactaacagcgcggttttgccgggttcaatccgccggacggggaatccgttgccgagagggccgagaacgtctatcctgccgccctcttttttctcggacaaaagacgcgttccctcaccgtcagctctgtagataacggatacttcattcgcggcgaaatcgacgtccgcaatgctgagcggtcttcttaatagcggcgtgaccgcgtcactcaccttcagatgtagaaattgacccggctcggtaaggtgccggacaagctctcctttcagcaccatcttataaatccggtcggcaatttctaagttggattgaacagtcaaatgcgcttttttcatatcgtggctgccgccttttgattggtttcggatgcaggcatatgatccgcccggaatgtcatgctttccaatacccgcaaaatggcttcagccgtatctaaagatgtcaggcaggcgactccattctcaacggattcgcggcggattctgaagccgtctctggccggctgtttgccctttgtcagcgtattgatgacaaattgcgcttcgccgtttctgatcacatcgagcagatttttcccttcttcgccgatttttccgacgacttgagccggaatctgagcgtctttcaaataagccgccgttccttccgtcgccaagattttatagccgatggcgtggaaccgcttcgcgatcagcagtccttcttctttatctttatcggcaacagtcaacagcactgagccgtagttcgggatttgaatgccagaagcaatcagcgctttatagagcgctttttccagggttgaatctttgcccatgacctctcccgtcgacttcatttcagggcctaacgtaatatctactcttctcagcttcgcgaatgagaagacaggcgctttcacgaataccccctgctgttcaggctgcagcccctcttgatagccgaaatcagcaagcttttggccgagaatgacctttgtcgccagattcgccatcggaatctttgtgattttgcttaagaacggcacggttctgcttgaccgcggatttacctcaagcacatacacttcaccttgcgacagtacgaactggatgttcagcaacccgatgatgttaaggccttttgccaaggctacagtgtattgttcgatttttttcttaatgtcttcgcttaaagactgaggcggatagacggcgattgaatcccctgaatggacgccggcccgctcgatatgctccataattcccggaataacgactgtttcgccgtcagatacggcatcgacttcgatttctttccccgtcagataacggtcgattaacaccggatgctgcgggttgattttgaccgcatttttcatatagtgaagcagctcttcttcgtgatagacgatttccatcgcccggccgccgagcacatacgaagggcggacaagtaccggatagccgatggatgcggcaattttgaccgcttcgttcaccgacacggcggtttttccgagcggctgcggcacattcagcgcctcaagcgcctgctcaaacttatcccggtcttccgcacggtctaaatcttcaagtgatgtgccgaggattttgacgccgcgggcgctcaattcttccgcaagattaatcgccgtctggccgccgaattggacgacaacgccttccggctgttccaaatcgatgatgtgcatgacatcttctaccgtcagcggttcaaaatacagtttgtctgatatgctgaaatcagtggacaccgtctcagggttgttgttgataataatcgcttcatagcctgcctgcttgatcgcccagacagaatgaacggtcgcatagtcaaattcgacgccctgtccgatacggatcggcccggaaccgaggacgacgacgctttttcttgatgtaacctcagactcgttctcttcctcatatgtgctgtaaaagtacggggtttctgattcgaattccgccgcacatgtatccaccattttatatacaggcttgatgtctgcttcttttcgcatttgatacagctcttgttccggcatattccattcccggctgatatatttgtcggagaaaccgagttccttcgctgtctgaaggacggcgaggctgcctttttccgctttcagctctgtttcaaaagcgaccagcttacagagcttgtgcaaaaagaatacgtcaattgcggaaaactcatgaagctgctccactgtatagcctcttctgaacgcttcagcaagataaaacaggcgttcatccccggcttttctgatccgtttttccaaaagtccgtcagaaatctcttccgcatccttcagttccaggtgatagacatcggcttcaagtgagcggaccgcctttaacagcgattcttcaagggtgcgcccgatggccatgacctctccggtggctttcatttgcgttccgagcctgcggtttgccgactcaaatttgtcgaacggccagcgcgggatcttagaaacgacatagtcaagcgcgggctcaaaagccgcatatgttttccccgttacgggattcatcatttcatcaagagaaagcccgactgcgattttcgccgcaagctttgcgatcgggtaacccgtcgcttttgaggcgagggcagatgagcggctcacccgcggattcacttcgataatgtagtattggaagctgtcgggatcgagcgcgagctgaacattacagccgccttcaataccgagcgcgcggatcagctttaatgaaacattgcgcaaaagctgatattcccggtcgctcaaagtctggctcggggcaacgacgatgctgtcgcccgtatggatgccgaccggatcgatattttccatgttgcagacgacgatcgcgtgatctctgctgtctctcatgacttcatattcgatctctttgtaaccggcaatgcttttttccagaaggcactgatggacggggctgagttttaatccgttttcgacgatctctttcagttctgcttcattcgagcagatgccgccgcccgttccgcctaatgtgtaagcggggcgcacgataaccggaaacccgatccggccgacaaattcctcggcttcctgtaaagtgcggatgatctcactttccggcaccggttcattcagctcattcatcagcgtacggaataagtcgcggtcttccgcctgctggatggcggacagctttgtgccgagcacttccactccgcattcctcaagaaccccgagttcagacagctcgacggcaagattcagtccggtctgtcctcccagagtcggcaggatggcgtccggccgttcttttctgataatacgcgtgagaaactccggcgtcagcggctctatgtatacccgatcagccatttccgtatccgtcataatcgttgccggattcgagttgacgagaatgacttcatagccttcttccttcaaagcgagacacgcctgtgtgcccgcataatcaaattccgccgcctgtccgataataatcgggcctgatccgatcactaaaatctttttaatatctacgcgttttggcataccgcttccccttctttctcagttgtttcgatcaagtcaatgaatctgtcaaataaatgattggcgtcttccggccccggtgaagcttcagggtggtactgaaccgtaaatgccggcaatgttttatgcttgagtccttcgatcgtttgatcattgatcgcaatgtgcgtcacttcaagctctgtctcatctattgaagaaactgtatatccgtggttttgggcggttaaagcgactttccctgtcgcaagctctttaaccggatgattggaacccctgtgtccgaatttcattttttccgtttccgctccggatgccagtgcaaataattggtggccgaggcagattccgaataacggcaccttcccgagtatgccttttatcatttcaatggcttccggcacatctttcggatctccgggtccgttagaaagcatgatgccgtccggcttgagctgaagcacttcttccgccgttacattgtacggcacaacgatgacatcgcattttcttttgtttaactctcttaaaatgccatgcttcataccgaaatcgacgagtacgatgcgtttgccgcggcccggactcggatatgccgttttcgcagatacttgagcgacttgatttctcggcagttccgtttctttcagccttgcaagaacctctccgacattctcctcacttgaagcaaacgttccttttaatgcgccggccgtgcggatcattcttgtgagctttctcgtgtcaatcccttgtaagccggggatatttttcattttcaaatactcgtcaagcgtgtaagccgaacgccagttggaaggcagctcgcacagttcttttacgatcagcccttttacaaaaggagtgatggattcaaagtcatctctgttaattccgtagttgccgatcagaggatacgtcagcgtcacgatctgcccgcagtaagaagggtctgataaaatttcctgataaccggtcattcccgtgttgaatacgacttcacccgcggtatgctccaggctcccgaatgcttcaccctcaaataccgctccattttccagcactagtcttcttttcatttgacgagtctcccttcttcgtatgcaagcttaccggcagccatcgttgcaacaggccagccgaagcacttcatcttgttgaatggcgtattttttcctttagataaaaatgtatctttgtcaatggctgcttctttttccagatcaatcagggtgatgtcagccggcgcccccggtgcaagcgttccgtacggaagatcaaatgcctcgcaaggttttaccgtcatgaaatcaaccagctgcttcagcgtccacgccccgtttttcacaaaatgtgtgtacagaagcggaaaggctgtttctaaaccgacgatcccgaaaggcgcaagcttcatatccgtgtttttctcttcttctgtatgcggcgcatggtcagtggcgatgaaatcaatcgtaccgtctaaaagcccttcaatcagcgcctctctgtcctctttgctgcgaagcggcggattcattttaaaattggtatcaagtcccgggatatcttcgtcacaaagcagcaggtggtgcggcgacacttccgccgtcacgcggattcccgctttttttgcgtctcttacggctctgaccgattctttcgtgctgatatgacacacgtggtaatggcagcccgccgcttccgccagcaggacgtcacgggcgatgtgtaccgcttcacaaatggaaggtatgccgttcaggccgttcgcttttgaaaaagaaccttcatgcacgctccctccgtaaataagtgagttatcctcacaatgagcgacaatcgctttattcattgaagccgcccgtttcatggcttcatacatcattccggccgtctgaacgccgacgccgtcatcggtgaaggcgaatgctccggcttcatgaagcgccttaaaatctgtcatttcttcgccggtttgcctgatcgtaatggatgcgtaaggaagaaccctgacagatgaggtttctttgatccggttttgcagccattccatctgctctttcgtatccggcaccggtcttgtattcggcatggctgcgactgtggtaaagccgcctcgcgccgcggctttagagcccgtctcaatggtttcttttttctcgccgcccggttctctgaagtgaacatgaaggtctacgagtcccggtgaaacgaacagtccgtcagcgtcgatcaccgtttctccgtctttcgctgtcagaagcccggtttccgaaatgaattcacccgttacccggatatcctgtgccactttttctccctgttcatttaacatccagccgttcctaatgagataagacataagccgcttctccccttttcacattggtttgcagtgctctttttaagactgccattctgatatacacgccattttccatttgtttaaagattcttgattttccgcattccactaatgttgtgtcaatttcgactcctctgttcaccggtgcgggatgcatgatgatggcatgccgcttcatgctctccgcccgctttgcggtcagcccgtatgcttccaggtagcctttttggtcggcttctgtctgatgcctttcattttggatgcggagcagcatgacgacatctgaagcttgtatggcttcatccgtctgtacacaggtgccgaaggcgtttttctcatcctgccattgcggcggaccagaaaacagcacgcgtgcgccgagccttgtcagcacctcggcatttgaccttgccaccctgctgtgtttgatatcgccatgaatggaaactgtcaggccctgaaaggtctcaaattcctcttgaatcgtcattaaatcgagcaatgactgagtcgggtgctggccgcagccgtcgccggcgtttaagatcggaatattgactctgccggtcagatctttgtaatattcatccgtgctgtgcctgatgacgcaggcgtccgctccgattgattccagagttttgaccgtgtcgtataaggactcgcctttttgaacgcttgtgctcgtatcgtctaagctgagcacgttcatcccgagtttcttttccgccacttcaaagctgaaccgcgttctcgtgctcggttcaaaaaacagattcgcaacaaattttcccgcgagatcggggcggactgttccctcttttatcgcttttgcctcacgcagcagttctgtaatttcagctgcgctcagttcagacatcgccgttaaatgattcatgtttttctcctccgtttccgcttgaaggccgtaaaaaaacaccccggtctatagactcggggtgcggttaaagagagaagcagcgtacagcttcttcccgttataacccttccaagcctctctggactttctttaaaaggtttcacatatgattttgtttttctgatgcaatcgcgtcttcttcatttgcatgcggcaggataaggttcaggatgactccgacgattgccgcaagcgccatgccggatatttggaacccgccttttgatacttgaataaaagcccctccgacaccgatcacgaggatgacggatgtgataattaaatttctcttgttttcataatcaatgttgttgtcaatcagcattcttaagccgctggaggcgataattccgaagagcaggaaggaaacgcctcccataaccgcggacggaacagagctgatcagcgctgatacttttccgataaatccgaagcacagcgcaatcacacccgcgccgccgatgacaaagacgctgaaaactctcgtaattgccaggactccgatgttctcgccgtatgtcgtcgtcggcgggccgccgattaacgaagcgatgatcgtcgcaacactgtcccccattatggagcggtgcagtcccggctttttaatgaaatcctgtccgacgactttactcagcaccatttgatggccgatatgttctgacatcgtcacgaaagcgaccggcaccatcgcagccgcaatgcccaatgtcactgacggcgtatagtctttgaaagggatgataaattcaggaacggcgaaccactttgcatcaatgaccggctgaaaattgacgatgccctgtgtcagcgcaaacagatagccgcctataatgccgatcaataccggaatcaggcttaaaaatccccgtaaaaagatggcgcagataatggtgatggccaaagtgacgccggctacactgaaatgtttcaagctgtagacgagttccttcgcattcggatcagcatacattgccatattgacggctgtgcttgccagtccgaggccgatgacgatgatgaccggcccgacgaccaccgggggcagcagcttcatcagccaccccgttccaagctgcctgatgagcagtgcgatcaggccgtacacaattcccgccaggaaagcgccgaccatggcagcccccggccctcccgtcgccttcaccaagataatcggtgatataaaggcgaatgatgagccgagataagcgggaatctggccttttgtcaccaagagataggcgagtgtcccgattccgctcgtgacaagcgccactgccgggctcattccgaccagtttcggcacgagtatggttgaaccgaacatggcgaataaatgctgcaggctgaatgacagccaagacaatggattggggacgtccctgactcccaggtttacttttttcttactcatggcgttttcctcccggttgactttcaaatggtataaaaaaacctctttgcttttggcgcaaagaggcatacaaaacccggccgcgtcgatccgcccggctttgtgttttaaaatcctctttgcaaactctctggaatgcatttaaaaagggtgattattcattttcgtaaatggcgaccatatcagtctgatcaacttcgctcagctgaaccattactttttcagcttttgaggtcggaatgtttttcccgatatagtccgctctgatcggcagctcccggtgccctctgtcgacaagcacggcaagctgtatcgatgacggccgtccgacatcaacgagggcatccatcgccgctctcaccgtccggccggtataaagcacatcatcaaccacaatgaccttttggtctgtaatatcggccggaatgtccgcgccttttacaagcggctcttcattgctcgtttttttcgtgaggtcgtcacggtaaagggtgatatcgatttccccgacggtgaccggattcccttcaatctgttcgatccgctcggccagccgcttcgctaaataaatgcctcttgttttaatccctacaagaatgcagtcattcattcctttattccgttcgatcatttcatgggctatccttgtcagcgcccgcctgatcgcctgttcgtcgagaataacagctttttgattcactcgtgacacctctccattcgtatataagaagaaaaaacccctctgccagagcatagaggggttcctttccaggacgaagacacacacgtgtatctcttctgtcctatccgttatccttctcagcctctctggactgtgttaaagaatctattcagcttgtttttattatttcagaaaagaaagtcgctgtcaatggctatttcttaaatcttcaatgagttttttcatatcttcaggaaggggcgcttcaaactccatgtattcgcccgtccgcggatgatcaaaacctaatattccggcatgaagagcctgaccattgaaatcaatggtttttctcggtccgtacttcgggtcgcctgccaaaggaaacccgatatatttcatatgaacacggatctgatgcgttcttccggtctcaagacggcactctacgagcgtgaaatcttgaaaacgctcaagcacgtggaaatgcgtgacggcgtttttgctgctttctcttgttacggtcatgctttgacggtcttttttatctctaccgatcggagcgtcaatcgttccgtcatcatgtgaaatcaccccgtggacaaccgctttgtactttctggtcacggttttattgacgagctgattaacgagtgattcatgcgccatatcgtttttagcgaccattaacagaccggaagtatctttatcaatccggtggacgattcccgggcgcatgacgccgttaatgccggaaaggtcgttgcagtgagccatcagtccgtttacaagcgtccctgtcacatggccgggcgccgggtgtacaaccatgccccgcggtttgttcacaaccaagacgtcctgatcctcatagtaaatgtccaaatccatcggctctgcaagcacgtccaattcttccggttcaggaatggtgacgtttacctgatcgccgggctgcattttgtagttcgcttttacggatttgccgttaacggataccaatccctcttttacccattgctgcacttgagtgcgtgaccagttttctcccgttgaagccaaaaatttatcaatccgttcgctcttttgttcaggctgaacggttatctcaaattgattcatgttattgctccttctttttcccgctgtcaaacagcatatgaataaataaaagtattacaccgacgcacagtgaggagtccgcgatattaaaaatcggatagtgataatccacgatgatgacatgaataaaatccaccacttcctggcgcgccgcccggtcaataaagtttccggccgcaccgcccagcattaagccgagagaaattccgagtaacatctgcccttttgcataacgctgtatgtaataaacgattccgataatcacggcgatggtaatgacgtagaaaaaccacatttggccggctaaaatcccccacgccgctcccgtgttgcgatgagatgtgatataaagcacctgatcgatgacaggtatgctttgtcccaattccatatggctgacgacaagccatttggtcaattggtcggcaataataataaaaagagcgataagataataaagcacacacgttcctccagtatacagttacttttatcctttatgaattttatcagtaaaagatgccagagtaaaggcagatcataagcgcatgcaaacagacgctgtcactcatacagcgcctgatcatatgcataatctccgggttcccaatatggaagggttttcttttcaaattgagcgggataataaaaatcatcagcggttctggccgtcggcagcaccgcaagtttttcaatcggaatgggggcgcctgttttttcacaataaccgtacgtattgttttcaaacttagacagggcaagaagaacgtcctgaagttcttcttttatatgatagatcagagttgcttcttggtcgttcattgaaggttgaacagatgctgacatttgaaagcaagaatattcgaataatcttgattgaagttcttctttcatcatgagaagctccgtgtggattgcggtcagttgatcattcattcatcacaactcctgctcttgatgttatggctttattgttgcccccagagcgtcatttgaagcccataagatttttcctgtcgttctaatcgatgacattagtggcatgtaaaaaagcgcccggctgacaccgggcgctttctcattcattatttttgataatatttttcaacgatttccgcattgcgcagtgatagtgtcggatatttcggattggctccgacatctttagaaattacgcgggaacgttcacacatctggccttccgctttttctacggtcatttttcctgttgtgaagctttgcgcgttttccggtgcttcactttcgtctcttactgtcagttctgagacgataaacagctgcgcgatattttctttaatggatgacaagaggtcgcggttttctttgttcggatacaaagtcaggctcgcttccaatgatcttccgataattttttcgttacgggctgtttccaaagctttcagcacgtcgtttcgaagctccatgaagcggtcgaacttttcttctgtcgcttgactgtccggaacagcaatggtttccggcatatctgtcagctgcacgcttgcttcttcaacaaatgataagtgagaccacatttcatctgccgtgtgcgggagaatcggcgccgtcagcttcactaacgccagcagcgtttcatagaagacggtctgcatgctgcggcggtccggatgatccgcatgctcgatgtacacaacatcttttgcaaaatcaagatagaaggagctgagctcgatcgtacagaaattgtgaatgctgtgataaacaaccgcaaattcatattcatcgtacgcttttttcaccttatcgatcagcttattcagcttgatcagcatatattgatccacttcgcggagatcttttacatcaacggcattgacgcttggattgaaatcgaacaggttgccatgaaggaagcggaacgtgttgcggactttccggtatacttccgcgacctgcttcagaatatcttcagaaaccgggtgatcggcctgatagtttacggaagatacccataaacgcagaatttcagctccaagctgttttgcgatttttgtcgggtcaatcgtattgccgagtgatttactcattttacggccgtttgcatcaagtgtaaatccgtggcttaatacgcctttatacggtgctttgccggtgactgcaacagcggtggaaagagatgagttaaaccagccgcggtattggtcagagccttcaaggtataaatcagccggacggacaagatcatcacgttcttcaagaacagcctgatgggaagaacctgaatcaaaccacacatccataatgtcttgctctttcgtgaagattccgttcgggcttcccggatgtgtaaatccttccggcagaaggtcttttgcctctctttcaaaccagacgtttgagccgtgctgtttgaacagctcagacacgtgttcaatcgtttcgtcagtgatgatcggctcaccgttttctgcataaaataccgggatcggaacgccccagacgcgctgtcttgagatacaccagtcaccgcggtcgcgcaccatgttgtaaaggcgctgttcgccccactccggcacccacttcgtttgtttgatggcatcaagcagatcggatctgaaatctttaattgacgcaaaccattgcgctgtcgctctgaagatggtcggttttttcgttctccagtcatgcggataggagtgtgtaataaactcgagtttcaagagcgcgccgttttcttcaagcttctccgtgatcggtttattggctttatcgtaaaacattccttcaaagcccggcgcttcgtcggtcatgtttcctttttcatcaacagggcacagtacttctaagccgtacttttggccgacgataaagtcatcttccccgtggcccggggcagtatgaacacagcctgttccggcatcggttgtgacgtggtcaccgagcatgacgagtgaatctctgccgtacagcggatgttctgcagtgatgtattctaattctctgcctttatatgatgcgacaacttcgggattttcaaagccgcatgcctccactacgttttcgatcagttcagctgccactacataacgcttgtctccaaccttgatgacattgtattcaagatcaggatgaacggaaattccgaggttggcaggcatcgtccacggcgtcgtcgtccagatgatgaagctttctccgttttccagaacgcctttaccgtctttcaccttaaacgcaacataaatagacgcggaacgtttgtcctgatattcaatttccgcttctgctaaggcagattcactggaaggcgaccagttgaccggcttcagacctttataaatatagcctcttttcgccatctcgccgaaaacgcggatctgctgcgcttcaaattcaggctgaagcgtaacatacgggttttcccaatcgcctctgacgccgagacgcttgaattgttcgcgctgtctttcgatctgctgccatgcataatcttcgcaaagcttgcggaaatcagcgacggacatttctttccggtttacttttttgtttttcgtcagcgccgtttcaatcggcagtccgtgcgtatcccagcccggcacgtacggtgcgttgtagccgctcattgatttatagcggacgatgaagtctttcaggattttgttcagggcatggcccatgtggatgtctccgtttgcataaggaggtccgtcatgcagcacgaatttcgggcggtctttcgtccgttcttgaacaagacggtaaatgtcctgctcctcccagtctttttgcatgtccggctcacgatttggcagatttccgcgcatcggaaaatctgttttcggcattaacagcgtatctttgtaatccattctcattcctccacaacatttttcagaaaataaaaaaagccctctcatcccataagggacgagaaagcttatctcgcggtaccacccttttagaaaaaacggatcatccgtcttttcctctcgaacatcgtaacgtgatggaacgtcctttcctactctcggttcagaaaggaaactaaagggctgatctgcatgattccggccatcccgggctttcaccttccccgggtcgctttatagcctgttttgagtcatgccggtccctttcaatcgtcttttcatctgaatttatgaacgtattatattcgaacgggccggagaatgtcaagaaaatcagaaaattattctttttcctcaaataccgcgtcgacttcgtattccagcagatgatcccaatcatcgttcttcagcagatcgagctgcgcttcaatcagcatttggaaacgtgttctgaagactttagactgttttttcagctcttcgatttccattgcgatttttcttgatttggaaagcgactcattgatgatgcgatcagcatttttttctgcttcacggacgatcagcttcgcttctttctgcgagttgcgctttacgtcttctgcggcttcctgggctacgagaattgatttattcagcgtttcttcgatattggcaaagtggccgattttttcgtccagctcgttcactttcgcctcaagctccgtttttttacggagtgcgatttcgtaatcttttctgacctgcattaaaaattcatttacttcatcttcatcatatccgcgaaaaccttttgtaaacgttttgttatggatatcattcggcgttaatggcatattgccacctccatttttacatttcagtacggttatctagttcacattataaaacaaatacggcacagatggagaaaaaaactgaaaaaacgactcatttttgccgttcaaatgtaactttccatttgtcttttttcgtttttccgtcaacttttgccaaactgcatcgtccgaagccgcgaatcgagagcatgtccccttcagcaacctgataagacggatcttcaatggctttccaattcaccttaacgagcccgtttttcacatgcgcctgcgctttctgccgggattgcctgctcattgaagcgcagacggcgtcgagacgcaatgaagaaaccgtgtcatcccttatttcgacatctgaagcggggatgtgaagagcggaaagctcgattttctcaagctttaccggcgctttgcccgccttggtcagctgagcgctgacaaaatcggcgatttcaccggagacgatcagctgcacggcttcctctgagaaaatcagatcgccgtatttctgccgctttaagccgatccccattaatgatccgagaagagagcggtggtcaatgctgacgaatttttcagcgtattgaacgtcaaaagcccgaagctcaaaatcatcctgttcaggttccatatattcagggtataaaatcgcgcgtttgcgctcagctctgtcatatcctccgaaaaacgcaagaccgcaggcgtcgccgataacggcttttacaatgacctgttctctgggatctaagaaatcagtcagcttcatccgatactggtccaggacaatctgtttccattcaagcgcctgatcaataaaaggccgctcgtcttgtctgaagtgctggtaaatatcgctcatgttctttcctttctatgtaaagaggcttggctggtgccaagcccatatcaaactgtcgcattcaagtatacattgcgatcatgcggtataggccccaaagtcccgtcgtggcaaaccgaagcacgataatcgctacaatcggggatatatccagcatggcaatgggcggaatgatccttctgaacggctctaaatacggttcgcaaatcgctgcgagaaaccgtccgaccgccgtttctctcgtactcggcacccatgacataaagatatagatgatcagggcaaacgagtagatgtaaattaaataactcagaacggaaaaaatttgataaagaatcatcctgctttaccacctctgatgttcgtcttcatttataagctccgaaatcgtgccggaaacgtcgacattatcaggcgtgcacagaaaaatatctgaaccgattctctgaatgtcgccgccgatggcgtagacggtaccgcttaaaaagtcgacgattcttttcgcctgatcatgctggatgcgctgcagattgacgacaaccgcccgcctgttctttaaatgatcggcgatttcctgcgcttccgcatatacacgcggttcactcaacaccactttagaggatttctgaacactttgcaagcttactacgttctgcttgccctgcggcttctgagcgtaagcaggctgtttatctttctgctgttcatgctcttccggatgatcctgctccgtttcaatgtattcgtactcgtactcctcctcatccattgagaaaaagtttttcagtttatttttcatgctcatttgtttacaccccccggttcatttccgactaatgaagagccgattctgataaaagttgcgccctcttcaacagcgatttcataatcatttgacatgcccattgacagttcccggcacggtgcgtttgtctgatgcagtttttgcacctgatcccccagatcacgcaattgccggaagcaggctctgatcgtttctgtatcgtctgtcaggggagccatcgtcatcaggccctctacagaaatgtttctaaactcagaaagctctctgataaaggggatgacctcctctgtttttaaaccgtgcttagacggctcaagcgaagtattcacctgcacaaaacagcgaaccgcatgctgcgcccgtttttcaatctcttttgccaatgacagtctgtctaaggaatgaatataagatacacggtcaacgacggccttcacctttctggactgaagactgccgataaagtgccactccgggctgcctttgatgacttcctgcttatggataagctcggcatcccggttttctcccagacttgtaataccggcatcaacggcctcttgagccctttcggctgatacgtattttgtaaccgcgatgacggtaacatcttcggggcttcggcccgatctgttacatgcttcgtttattctttcgtttatatgtcgtaattgatcagcaacacgcaagatcttacgcctccttcattccgataaaggacatcatgcgtcccgttttccctttgtcgcggcggtgtgaaaagaatagttcacgctctcgttcggtgcataaaccgctgactgaaatgttttcttccggaatgccgcaatgtatcagaagaagacggttgacctcttttaaatcaagctgatactggcctttttccgtttcgcatatggcggattcagccgtaaaaggcagcgcccgcacttcattgatgacgcggtcgtcgactgtatagcttcccgcgctgatggacggaccgatgacagcctgaatatctgttaaacgggagccttcttcgtttacccagcgttccgtcatgatgcgtccgatttgtttgaccgtccccttccatccggcatgggcagcgccgataatggatttcaccgggtcataaaaatacaagggcacacagtccgcaaaacaaagggccaaaaaaagattcgcatctttcgtgtagagcccgtccgtcccgcggaatgcggaagaatagtctctcgctccttttcctttatccccggctgtcacgcgccggacgcggttttcatgtgtctggtcggcgaacacccaggaatccagatcagtaccgcataaggacgctatgacttcacggtttgtcacaacatcatgagcttcgtcccggacgtgcaatccggtatttaatgactcatacggaggattgctgacaccgccgtttttcgttgtgaatccggcgatgacctttgtgttaagctgattcacacagttccagtcttctatcatgagtgccgagggggtggtaagactaaacgggtgatatgtattcatggagatccaacctttcgacaaacattaaaaaagcgtaatttcccactcattttaacacaattttaagcatacgtttagcggctgattgaaaaatgagataaataaatgtgccggaaacattgagatttccggctttttacaagtaaagggaggattacgctcccccctttggttcgtttacacgcactaagatgacatcttccccaattttaactatatttcgccaaggaatgatcatttcctcttcttttccgaaaaaaccgagaacttttccgctgccgcctaaaataatcgcctgaatttttcccgttgtcacgttaatatcaatatcaccgatgcttccgagtttttttccgttcgacacgtttaccacatcttttatttgaaattcagatatgctgatcatccgtatcacgccctttgcccgttctttttcctattatatgaacggccgggctgaaccttgtcacatcgggcaatcttttttgcggctgcaccaggcgaggataaatctcagcataattttcgtatagtccataagctcatcaacggacacttcctcgtttacggagtgggcgttttttaaatcgccgggaccgtatatgacgctcggaatcccggcatgataaagccaccctccgtcagttacggtttgggaaacatcaatgacgggctcctgttttctgacggctgagtgtgatgcagccaagacagaaactgccggatgatccgggtcgatttccagcgccgggaacacctctcctctgtcttcaatcatcgaagatccgccccatttgaacaccggcctgttttctttgagccacagatcactgtcagcgacacgattaatatagtcttcgatttctgcggctgcttgttcgtgcgtttcgttcggataaaagtggacggtgatccataaccggcattcatcggcgacaaacgctgcgtgtcttccgccttcaatgacggcggggttgatcgtattggtgccgggcgcaaaaccgggatagcttttcgttaccgcccagtggcgctccagctctcccaaggcagtgatgattttcgccattttttcgatggcgctcgctccgaatgtgcctccgcccgcatgaatcatattgcgcctcatgccgtcatgaaatgtttgtttgcttttcaattctatccagccggtgatgactccgccctgcccttgaatatgcaggctgctcgtatccgcgacaacggcaaaatccgcgtgatagccgcgtttgcagcattccagcgtccccgcctcaccgacttcttctccgattacagactgtacaatgaggtcgcccggaagctcaatgccggcatcatggatcagcttcagagagaagagaacacacgccaaaccccctttcatatcagcggcgccccttccgatcagcatgccatcttttacgtgcggctgaaacgggtcagagtgccagtcttcgcccccggcttctgccacatcaatgtgtccgtttaaaatcaggctttgatgcctgcttgaatctgtcccttttaaaacaccgactacattcgggtcttccggatacacatcccacatatcgaccgagcagcccgtttcttttaaaaagccggccacccacttttgggcttctgccgtatttcttgctggcggggccggagtcggaaaggctatcaatctttcagcaatatgtatgaagtcgtgccgccgtttctccgcctggtgtaacagcatatcaatctgatgcattggaaatctcccctttggctgtatcaaaaaaaccgtttcattcatgaaatgaaacgggtaaaaaacgggtcttcctccgcttttttcaccgcttccctccgccggcatgatccggatccggtcctttaagggttgagacaacgtctctctcagccgcatggcagcacccccagggtgaatttatgttattttacggatgatgcctcttttgcacgtgttaaaaacgggcggccattgttccataagacattgacaggcatatcgaaaaacgctgtaagccgctcgtcagaaagcatgtccctgattttcccggaggcgaacacctcgccctgttttaaaagcagcgcctgatcaaataccggcagaatttcttcagcgtgatgggtgacataaaggatggacggcgcattttctttttcggcgatcgacgtaatcgtgtccagcagctgctcccttgccataaaatcaagacccgtcacgggttcgtccagaatcagcagttccggatcagccataagcgcccgcgcaatcagcgctctctgtctttccccttgtgataatgtttcataccgtctgtcggcgtaaccgatggcgcccaaatccttcagaagaccgatcgctttttcccttacctgctcactcggagtttcgtacagcccgattgaggcgtacgcgccgctgagggcgatttcaaaagcggagtccgcggcatataatttgtgctgaagacctgccgaaacaaggccgattttccttctgagcctgtcaccgagctctgttttgccgaattgatggccgagcacctgcatctctcctgaagtggggaagtaataagagcataacatattcagcaaagccgtttttccggctccgtttaatccgtacagcacccaattttcgtttttctcgacgcgccagttgatatctttcaaaatccatttcccgtttctttttaatgacacactgtccagctgtaaaatcattgcagtttcccccgtttactttgtttaaattttctaaaaacttttacacattagaatacatcacttttttgcaaacgtaaaccatcgcatgaaaaaagcctttaaacaaggtttaaaggctttttccgttattgatggatattcttattcatttgtttaatggctgccttttcaagccttgagacctgagcttgggatatgccgatttcttcagcgacttccatttgggttttcccttggaaaaagcgctttcgcaaaatcattttttcccgttcgttcagtcttctcatgccttctttcagagccagctcctcaatccattgtgtatccttattgcgctcatcgctgatctggtccatcacgtaaatcggatcgccgccgtcattataaatcggctcaaacagtgaaaccggatcctggatggcgtcaagggcaaacacaatttcttcatggggcacttcaagaactttggcgatttcctctgctgtcggctccctgcttgtctcactgattaaccgctctcttacttgaagcgctttatatgcgatatcgcgaagcgacctcgagacgcggatcggattgttatcccgcaaatatctgcggatttctccgatgatcatcggtacagcgtatgttgaaaacttaacattatggcttaggtcaaaattatcaatggatttcattagtccgatgcagccgacctgaaataagtcatcaacatactctcctctgttgttaaacctctgaatgacgcttaagacaaggcgcagattgccgtttacaagcttttccctcgctgaatcatcgccctcatcctgtaattgcctaaacagctttctcatctcttcattcttgagcaccggtaatttggaggtatccaccccgcaaatttcgactttatttcttgacacgtttttccctcccactaggagctgctgtacaacgttaagtatctcctcgggtgggaaaaatatgcaccgccattttacagaaataaacatccggcgacggcaatccttgcggcagtaagggctgtcagatggaaaaaattttacaccattttgttaaactcttttctcagtcttttgataatccgcttttcgagccgggagatataagattgtgaaatccccatcatgtcggctacatctttttgagttttttcttcttctccgacaagcccgaaacgcagttccataatctgcttttctctttcgtttaattgctcaagcgcttttttcaaaagttttttatccacattggcttcaatgtcttttgtaataatatcatcatctgtgccgagcacatccgaaagcagcagctcgtttccgtcccaatcaatattcagcggttcatcaaaggacacctctgaacggattttattgtttcggcgcaagtacattaaaatttcgttttcgatacatcgcgacgcgtaggtggcgagtttgattttcttttccggattaaaagtgtttaccgctttgatcaaaccgatggtgccgatgctgattaagtcctcgatgttgatgccggtattttcgaatttgcgggcaatgtaaacgacaagacgtaagtttctctcaatcaggatggcccgcgccgcctgatccccgctcggcagctttaataagagcacctgctcctcttctttagacaaaggcggcggcagcgcctcgcttcctcctatgtaatacacttcatcgcttttcagtccgagtttcatcagccatttataccacaaatatgtcagacgcagcttaagttttttcatcttcctcccccttctaaatacaacgcgttttgagtatgatgaataacagacttttcgtcaggaaacatgttttacagccttccctgtcagcatcttcggatgaacgattccgtcaaattcaccgtccgcggataatggtttcgtgctgatgccgatcaggcatttttcacaagcgatcatttcgtcttttgttaaaatcgtgacgtaatccggctttaaacagagtaaaaattgattgtcctggccgacgcccctgtatggaatcagcctcagcttatccgcatggcggaacgaatcatcaagctgctctatcacttcaagcaggctggcggatttgatgaggtccgtttccttttcgctgagaatcagagcgaatttgtcaatgtgaaggatcatgaccggcgttttcgtcagcggatcatacagctgattcccggaatccaccaatcctttcgcgcggattgtctgtccgctgaattccgcctgcaccatgacaagttcatcgtactgaatggacttcgtctcgatgtcttcaattctctttttcgagaaaaaccatatggccggaaatccgataactacaaacatccagctgatcgggtcgccgaatccggtctggcttgtgaccattaccccttgctgcacaattgattctgtctgcagcagggaatgtacgccgatcattcccccgccgacgagaaaagtcgcgaaataaaaggcgaacaaattttgaaaaaagtatcggaaccgtttaaagccaaaagccgcaagcacgatgactactgaaaacgccatttttcccgccggatgctccacaaagggagaaacaggcgtaaacatcagaagcacaatggctgacccgatgaaaccgccggcggccactcttctttttttcacctggcgttttaaaataaaggcggtcaataaaagcaaaagagaatcaaaacaaaagttcaacagccaaatgacatccagatagattttcacatctgacccctttcctcttttgtcttacttatctgtttctctctcttgtttcataagtataaagcaagctctgtgggaaagtctgtcaattaatgttgagggtaaagtacaatttttaagggataaccgttttatttgtcgagggccgaaagggttgctttcctattgtccgtttcaactaaaaaagcgctgccgtgatctggcagcgctctgtttttactcattgatataaagttttcctttagccgtctgtctcgtttcatttccgtagtcatctcttgcgataacgtcaatttttgctccgcttgctttgatggaagaggtcgccgtccagtaaccctcatatcgtcccggagaaatttctctcagcggaagctctgttgcgttttggctcccagcccgggcgtttgtcagaggcagacggataacgaaggaagcgtctaatttctttccgcttgaaaaagcgattttcactgattctccggcttttaattccttatccgctccgggaaccaatccggaaatgacgggagcattgtaattgacatcgattaccgtctttttcgttgttttgttacccgcttcatctgaggccgtgaccttgatctcattgctgccgttttccagaagggttctcgcttgataagaaccgttatttacttcagctttttttccgttcacctttacccattctaaatgggcgtcgtgcacttttccttttacggtcactgcttctttatttgttttatcaccgtttgccggactgtcaatcgtcacatccggcttatcctcatccagtatgaccgtgacagggcgtgactcatcggttgacccgctgtctgtcacagatgccgccgtcagccgattggcatcttcagtgagtgtgacgccggcctggaaattgccgtctgcatctgctttcgtttctgcggcggttttaccgttattggtaagacggacagcggtttttggtgaagccgttcctttcaccgtgattgacctcttgtttgtaaatgaccggtcttcaggcgacgttatgtcaggcacagaagcttcgtagtcgaccaaagccctgatcataaagtttccgtctgatttatcggttttagaccagcggccgtcgaggtattgccagtttctgttcgagtacggactgccgtcatcagatgacagggcaggtgtataaggatcgggtttcgtctggcggaacacaagataaaaatcctttccgaccgcgattccttttgagctgagatccactttggtccattcgccgtttcgaagcgcttcagcttggaacgggccggcaattttgctgcccggagctccatcagggccggatgcatcatatacttctgcttggaattcggtaccgcccggatcaggccagtcggcgccccaaaatttaaaaaggcctcccgtcagcataccgtgttcttttccgtctttaagcgtcatctttacggcagatttgctgccggctttaaaatatgacagcgcggcttcttccgctccgttatcataggcaatttccccttcataaccgatatacggcttaagcttgacgtttttttcagcatctcctttgatgtcaacggaaaattcgctattgtaaaagccttttgccgctactttgattgtgtaggagccttcgtacgccttaagcgaatattcccctttatcgtttgtcaccgccggttcaattgcggcatcctcagccacataaagcgcagccccttttaccggttcgcctgttgactgattggtgatggttccttttagcgtgccggacggcatttgctccagtgtaaagtctgcctgtgcggttttgtctgattgaatagaaacttgtttcgaagcggacttaaatccgtaagcctcggctttcagcgtatagcttcccgccttatgcgacaggctgtagcttccgctaacagggtcggaatatacggatttccccgtctcggcgacactgatttgcgctctgagagggaggaggtttgtttcacgttttactctttttccgggtgatttcactgccggtttggcctgtttcggactgactgcttttttcttcaggtggccgggaggtgtttgtctattgtgtttactttttttagccgccttgccgagagggctgcttgaaagccggacatcatcgatataccatccgtcttcattgagtacttcgtctgactgcatattaaacatgagctttatgttttggcctttatacgcagataaatctgcctcttcatcgttccatcctgcggagtcaccattgtaaacggccgcctgctcccaatttgattttccttccggaagaacgaacacatacccgtaatcaaaaaattcttcgagcttgtgccagcttttaaattgcaaaaacagccgtcctgtttccggaacttgaatcggaggcatcaccaaattcatgttggctgaatcggcataagggccggacagattcgtcgcatacactttatctccggaaaatgcggcgccgggccctgaactcgggataccccattcccattggtcgtgtgtcccgtaactggaccagcccgccggctgtgattcaaaatcctctttgtatcccgccgtaatgctcggtttcacgtcagcccggtacgtatcagattctacagaatgacctccgaaatcttttatggtccatttataacttaccttgcttcccgttacatccggaatctccgcctggtatgttccctttttttcatcaccgcttttttgaacggcggctgtcgttttccactttccttcatcaaactgataggaaaggctgacttcagttacacttacatcgtcttctgctgtaaccgttaacggaaggtttgcccctttgtaagccgctgagaccggttcatggtgaaagctgggcggattgtgatcttcgcccgcagaagagaccttgccttctacgcctccgattccgtccgttacggcagaaacggcatcaaaagcgttaacgagaccgtggccgtaaccgttattcggtgattccggaaaaacggaatctgtcagcttttcggcggtgcgcgtcaaaacgtcttccatttcatcgaccgtaatagaggcgttcgcctgccttaacaaagccgccgtcgccgccacatgcggcccggccattgaagttccgtcccagccgccttcgtatgttcctccaggaatcgaagaacggatattcactcccggagccgaaatgtccggttttgtttcatgatacggtgaggggccttgaagtgagaaatcagcgagtttcttgtcgatgtcagtcgcacctgtcgcaaatgcttcaggataattggccgggtttgcgattgaacccggtcctcccggtgtaaataagtcttcatttcccgcagagaattccggaaaaatccctgccgctctccacgcattcaccatatcgcggtaccactcgtccattcccgaaccgcctgcccaggaattattgacaacatccggcgccatctcgggatgcggcgtgccgtttttatctttaggcgcgagcacccattcaccggcatccaaaatatcggcatcagttcctccgtcatctgaaaatgcttttactgcgatccattttgcccccggagccacaccgatttgatttgagccgtcaggttctgaacccgtcatggtccctgttacatgagtgccgtgttcaagatcatcgtagggagcgtctttatgggacacggcatcataccagttcatttcatgattcggcgctgcgggattttcaggatcgtaaccccggtatttttctttaagcgccggatgatcccactgaactcccgtatcaatggaagcgacaaccgtgccggttccgtcgtatcctgaagcccaggcctgcggcgcatcaatttggctgatattccattcgatgccttcctttgctttgatctctttttgttttttcttcatttgaaaaggagcttttgattgtcgttgagtaagctgacgtttttcattcggaagaactttttctacttcaggaaatgaggcggctttttccattacctctttcgaagcagtgactgccattccgttaacaatataataggaatggatgtgatcagccttgcctttctttttttgtttttccaaatatgttttcagattctgctgcgcatcatgagccgccagttttaaagaagaaacgacggctgaccgcttttgatattcggtttttgctgcggaaagcgattgagacttggcgtttttttctgcttctttgaccgcttttttcgtattggctttctctttaaatttgataagaaacgtgactttatcatttttttcaaaacgcttcttgactgaatcggaaatcttatgctgaatgctcttagaggaagaaagatctttggtgaaagaaactgcccccggtgtgctgttcgctccggctgcacccggaaacaacagggaactgacgacaatcgcgcttaaaacggagcctgtccatctgtttcttgtttttttcttcaatcgtatccccccttatttggtaacgccctataaaatgtgtatccctccttcataattggaatcgtttgtcatttcgatgctgtacgttaaatgtagacaatcttccatccagatattgtcgcattctgtagaaagccgtatgaaactaaaaaacaatcaattcgtcataggtataaagtttcttttttcactgtatagatcatggggataggaaggaagactgtacacaaaaaagaaaaaggacaaaaccatgtggtcttgtccttttttacatcagccgcgtttgttgcggtttcttaaaaatgtaggaatgtcgagggcatcatccgccggctgtgatgtatggcggttcaccgtgttttgatgctgtgtttcttctcgtttcggctcacgtttcgcagcgttttggctttgagacttcaatccttggtttaaagtcggacgctgcggttttgagtcatctttttcctgttcgataaaaccggtcgcaataacggtgacgacgatttcatctttcagattttcattgataactgaaccgaaaatcatgttgacatcagggtcggatgcagaagcgacgatgtcggctgcttcctgcacttcgtagaggctcaggtttgtacctcccgtaatgttcatcaaaacaccttgcgctccgtcgattgccgcttccagtaacggactggagatcgcctttttggcggcttcagcagcacggctttcgcccgtagcgatcccgatacccatcaatgctgaacctttgttggacatgatggttttgacatcggcaaagtccaagttgattaaaccaggcgtcgcgatgaggtcagagataccttgcaccccttggcgaagcacgttatcagcttcacggaatgcttcaagcatcggtgtgtttttatcgacgatttcaagaatgcggtcattcggaataacgatcagtgtgtcaacggcttctttcattgccgtgataccgcctgcagcctgcagctgacgttttcttccttcaaatgtaaacggtcttgttacgacaccgacagtcaaagcgcctaagtcctttgcgatttgcgcgataaccggtgcggctcccgttccggtaccgcctcccattccggctgtaacgaacaccatgtcagcaccttttagcgcttcttcgatttgttccttactttcttcagcggcttttttgccgacttccggattcgctcccgctccgagaccgcgggtcagcttttccccgatctgcattttcacttccgcttttgacaggttaagagcttgcgcgtccgtgtttaccgcaatgtactctacaccctgcacttcattttcaatcattcggttgaccgcgttattaccgccgcctcctactccgattactttaattgatgctaagccgtctatgtttgtttcgaaatccaacatgctaaatcctcctaatctgccgaatgactatcaatctattcccaaaacatgcttaatagttttttcattttgctcggtttgttgtgttcggcttgtgttttttgttttgcttttggacgctgctgcgcctctggccgctgatgatgttcttcttcgtgagagaccgcgatttcctgcacggcttcttccggcatatgaaagcctatttttcttccctgaattctggcatttcggcaggcaaattgtatcaagccgacacccgtcatatactgagggtcccttacaccgatataattcgggcttgcgacccttacattgtgcctcagcacttcctgtgccaatgaaagcactccgggcattgcggcctgtccgccggtcagcacaaagccgccgggcagatctgtaattcccatatgctcaatttcggctgcggcaatctcaagaatctcttccactcttgcttcaataatattggcaatttcctgctgtgtaaaagattgcttttgattcgttcctatgacggtgacttcaaatacttcatcttctgaagcctcatcgtagaatgcatgtccgaattgtttttttactctttcagcctcttcggtggaagtgcgcaatccgatcgatacatctttcgtgatgttttcgcctccgagcggaatgacggctgtctccttcaggtgcccctgttcaaataccgccaccgtcgtcgagccgccgccgatatcaatcatggcgactccgaggtttttttcgtcttttgacaaagccgccgaaccggccgcaagcggctgcaggcaaatatcagtaatttcaacgcccgctctctccacacagcgaagtaaattatgtaagatcgttttggagccggtaatcagcgtgccttctacttccaggcgcacgccgagcatttttttcggatcggtaatttcgtctcttccgtcaacaataaactgtttcggaacgacgtctacgatcagctgctcatgcggaactgacacgacctgtgccgcttccattaccctgcggacgtcttcaacgtgaatttctttgttttcactggaaacagcgacaacgccgttcgtatcttgaatatgaatataatttccattaacgccgacaatggcttttttcagcggaaaacctaccattctttcagcttggtcaaacgcttttcttatagaatgaacggtttcatctatatcaacgattgagccttttttcaacccttcagacggtacatttcccactccgataatgttaagggaatcatctgtcatttctccgacgatcacttttgtattggacgtaccgatgtcaagactgacgtaaagttcattgttgttcattctatggcacctcctcacatttcgatcaaattctattctattatttgcggaacaacaatacaatgaatgtggctttacaagtgtgtaacaaaaacaacagcatcaacaaattcttatctgatttctcacaatttatgtttaatgaaactattcgttatattctatgtatatcctcttttatatcgtattttttttattttttttagagacggcccaccttaccgtaagatttcctttcacggtgccatactgtgcaaaccagatgcaaatatacccgctttccattagtctacactaagatgaacctccagaaaagctatagatattgccagaaacatccgaaaaaagaagaaacaggaggaaaattccaaatgcaatgctcattgcagaagacacgcccattgcattgagaattttccgcttgtccggcagccatatcccgggcaaaaacaaacatagtcataatgattccgctatcggttatatcggctgccccgctgattgtaatagattcttttgaatcaccttgaaattagttctttagaactattaatcattttcttttttcttgccggatttacctttgttaaattcttcaaaatacgtagcgacttctaagtggataatcccctttttcccgccgtccagctgggaaacgatagatggataggtcttcatccggccggcaaacgttttaatagaagcggtaactacatacccgtcgttcatatacagcttgatccggtcctgatccatttttaccggtgtataatagatttcagaaatcgactgcttaagcgaaccggaaagcttatcaagctgctccgccattttgacccgctttttcgcgtttgtccagtcaaccaaaatcgggcccgcgtcatccggcgtgacttcgttcggcagcacagtgccgttttcgagcacttcataatatacatcatgtcgctgcagatacgcgatcgtcttgtattcttcaatgtgaatgctgactttgttaggaaatacttttgaaagttccgcctttttcaccagcttattctgctcaatcttttcttctgtttgtttcttgttcagactccagaactcggtttgtccgttatgtatatcagaaagcgcgttgatctcttttacagacacgttttcgtttccggaaacggtgacagaagacactttgctgatcggcatctgcaagtacacgatgatcagcaccatcataaaaaagagcacaatgaatgaaatcagccggcggtttgctttttgcttccgctgctctttgattttcggaatccgctcttcaatatttacaattttttctctttcatgatttgggttcactgcctgtccacctcactaagaatgaaacagcttgacattcgtctgattgaaaaacaaacggcatgctgtgatgccgtttgacatttgttaaaagtatatcacatgagctcacgtaatcagagaaccttttaacgattccctccgatgatttcaacttctgtatgcatgtcaacatcatactgctcacggattgtctttttcacatattcaatcaggtcgagaacgtccttggcagtcgctccgccggcattgacgataaaattcccgtgcatttcggacacttttgctccgccgatctgatgtccttttaatcccgctttttcaacgaggtttccggcatgatccggcagcggatttctgaatatgctcccggcgcatgggcttgaatacggctgagtgttttttctgtaatctttgttctgctgcatttgcgccgtaatggcttcccgttccttttgctcaagctgaagaactgcctcgagacagacgccggggcgttttttctgcaaaacagacgttctgtagctgaaatccatctcttcgtttgtcagccattcgattgtgccgtcttcaaataagatacgggctttcacaagaatctcactcatatcagatccgtgcgccccggcattcatatagacggctccgccgattgatccaggaatgcccgctgcaaattcgagaccggacattccttttttactcatggaagtcgcaagccggacgaccgaatagccgcctccgaccgtcacctgatcaccgtcaatctccaaatgatccagacccgctcccagcttgatgacaactcctcttatgccttcatcaagcacgagcagatttgaaccgcgtccgataaccgtccatggcagatcatgtttcttcacaatatccataatatctttgaccgcttccacacggttggggatgattaaaatgtccgccggaccgccgattttcatcgttgtatggttcgcgagcggttcttgttccagcactttgccgacttcgcggtctcttaattcctgaattacgttctccatcataaacctccgcattccatttgctctatttttttatgtcttccatgatactgtacagtctggctgccgcatccggaacaccgagtgattttgtccgctcactcatgtcttttaaggtttcttcattcatgacgattttgtccagcgcagcgatcagtttttctccgctgagctcggtttccttcagtacgattgcagcgtcatgctggctgagcgccttcgcattgacttcctggtgattggctgtcacatacgggctcggaataagcacgctcggaatgccgagagcggtgatttccgcaatcgtcgtcgctccggctctggccacaatgacatcaattgattgtaagtactccggcatttggtgcaaaaacggttttgtcaccatattatcagcggcttttccgcctttcagctcagccgttaccttctcgtaatgcacttccccggtaatataaagcacttggtaaggtctcgttttcaattcttcctgcatatctataacggcacggttaatgggagccgcgcctctgcttccgccgaaaatgagcaccgttttttgattgtctttcagcccgaactcagttaatgagcggcctgtcttaattgagacgacttcagaggctctcgggtttcccgtaaacacaactttttcagcaggaaaatgcgattttgcctcttcaaagcaaattgctaccttattaacatatttcgagagaaacttatttgtgatgccgggcaggctgttttgctcatgaatgatcgtcggaattcccatttttgccgccgcgtatacaaccggaccgcatacatagccgcctgtaccgataacggcatccggtttaaactcttttaaatatgatttgcttttcttcacgccttttaagaaacgcatgacggtttttacattttcaaaagaaagttttcgtttgaaacctgtaatttcaatggcgcggaacgggatattttcccgttcaacaatttttttctcaagaccgttctctgttccgatatacaaaaattccacatccggatgccggcgctgaacttctttaataaaggccagggccggataaatatgtcctccggttccgcctccgcttactgcaatacgcattcgtatgtcccccttaatcacatagcgataaccctgttttttaggacagggttattgatgttgtctgtttttttatagataacgaataaatcatgagtgatgaggcaagatacagatcaatacctcgagtaccggctgacatttaaaagcacgccgaccgctgcgagcatcagcgtcagtgatgagcctccgtagcttaaaaacggcagcgtaattcctgttaccgggatcagccccgtcacaacgccgatattaatcatgacttgaatagctatcatagaaataataccgatagcgacaaagcttccgtataaatccggcgcgccgagggcaattctgacgccccgccataataaaatagtgaacagcagcaatatgagcgaaccgccgataaagccgagttcctcagataaaatagcaaaaatgaaatcggtttgcggctccggcaggtaaaaaaacttttgccggctttggccgagccccatcccgaacagtccgcccggacctacggcatagagcgactgaatgatctgaaatccgcttccaagcggatcctcccacgggtttaagtaagaggtaatccgtttaatccgataaggagcggacagaactagtgccgcaaatccgcttaaaccgatgagtccgaggaacgcaaaatgagcgattcgcgcaccggaaacaaaaatcatcacgatgcacgtgcccaccattaccgtccccgttcccaggtctggctggcacataataataataaatgcagaaaacacgattccgagcgcgggaacgaatccgcgtctgaatgacgtaatattcttctgtttttcagaaagaaatttagccagaaacgcaatcatcgcgagtttcataaactccgaaggctgaatgctgaacgctcccactccgatccagcttcttgaaccgttccgcaccattccgactcccggaatcagcacaagcacaagcagaaaaaaacatatgatcagaagcagcttcgaccatgtgcgccatgtccaataatccacattcataatgaaaaacatggcaatgacgccgatccccgcaaacagcagctgccgtttcgcgaagaaaaacgagtcgtcaaatttataatccgcccataccgcacttgcactgtagaccataattaatcctattgttaaaagcaataacgtaatgataactaataacaaatcaggcgctgtttttttagtagtcaaagcaatcgacaccccaagcataagtcatttagggctgccgatgaacagagacaagcccttacttaagcatatgcacggcatctataaacatgtcaccgcgttcttcaaatgttttgaactgatcccagcttgcacacgcgggtgacaagaggatgacgtctccttcatttgagagcgcaaacgccgcagatactgcttgttcaacattatcgacacgtttgacatgttgtattcccagctcattgcccagtttttctatcttcggcgctgtctgtccgaacgtcaggaccgctttgacattgtccatatacggtttcaggtcgtcaaaaccgttgccgcggtccagtccgcctgcaagcagaataaccggtgctttgaacgccgagagcgctttgcttgtggccaaaatattcgtcgctttgctgtcattataaaatttgcgattctggatcgcagttacatactgcagacggtgtttgacaccggtaaagcttgtcagcaccttctgaatcgctttattagacgcgcccgccgtttttgccgcggctacagcggctaaaatattttctaaattgtgcgcgcccggcagtacgatgtcatcaacaggcagaatcgcttcatcgccgaacatcagcattccgtctttaatgaatgcgccgcttgacagttcctggtggactgaaaacggaacggtgccggcttttccgctttcggcaagccgcacgactgtttcatcgctttgattgacgatggccgtatcactctcaagctgatgaagatacacgttctgcttggctttttcatagttttcacggctgtgatggtaatccaaatgagcgtcgaacacatttaaaatcaggccgatttcaggtctgaacgcatgagtccccataagctggaacgaagaaagctctgtgacgatccattcatcaccgtcagcatgataagccacttcactggcgacagtgccgatattccctgcgatcagcgcctttatcgaatcagctttcagcatttcataaatcagggtcgtcgttgttgttttcccgtttgaacctgtaatgccgatgaattttgcattggtgatataatacgcaagctcgatttccgtccagaccgggatgcctcttctttgcgcttcctccaccatgatattttcatacgggattccgggatttttgatcagaatggtaatgtgatgctgatcaaaaagtgacgtcggatgctcaccgcagatgacttcaattcctctttctgcaagcctttgggcaggttcgttctcttcaaaggctttttgatcattcacgacgacgttaatgcctttttcatgaagaatcgacgcagccgcatatccgcttttcgccagtccgaggaccagaaagttttgtttttgcaaaaaaagttcgttttccacttataaccacacctcgatgtaaattcctaaaacggcaagcagcagtcccgcagcccagaatgtgacgacaactctccattcagaccatccgaccaattcgtaatggtggtgaagcggactcatcttaaagattcgttttcctgtcgttttaaagctgatgacttgtaagataacagataaggtctcaataacaaatactccgccgataatgacgagcagaatttcaagcttcgtcagaatggcaacggtcacgatcgctcctccgagcgcaagcgaaccggtatcccccataaataccttggcgggatgggcgttgaatacaagaaaaccgagaacggcgccgacaacggcaaccgagaaaatcgcaacgtcatattgtgactggttccacgcaaggatggcgaaagcgccgaatgcgatagccgcggtaccggacaagagaccgtccagaccgtctgtcaggttgacggcatttgaacctccgacaagcataaagagaacgaggataaagtatccccagccgagatcgattgacagatgtgtgcccggcaccctgatgccggttgaaaaatggcaataatgatatactccgtaaaatacaatggcaataatgatctggccgatcaatttctgcttcgacgtcaatccgagattccgtttcattactactttaatatagtcatccagaaagccgagcaggccgtatccgatcgtgacaaacagcagaagaaacatttccgcgctcagatgcgaaaatttctgcgtcatgacaatcgccgtaatggcgatggatacaataatcatgaccccgcccatcgtcggcgtccctgattttttcatatgtgatttcggcccctcttccctgatactttggccgaattttaaacgtcttaaaaacgggataagaatcggagatatcagaacactgattaaaaatcccattattattgtaaataaaatcacttgctcaagcattgctcttttctcctcccgtttcgttcaaacgacatacgtatttatcatattcacattgtgtccccgtaattcttttcatttccctcattctaacactctttcctgttttactttttattcagctcaacaatagctcttcccgctacttcggcgtcatcaaagtcgaatgtttcattgccgatctgctgataggtttcatgccctttcccggcaatcagaaccacatctccctttttcgcgttggcaatggcaaaaaagatagcctgctcgcggtttgcgatactgtgatagtaagtgccttctacccctctttccatatctcttaatatggccagcgggtcctcgcttctcgggttatctgaagtgaaaatcggttcgtcggcaatccgcaccgcaatttccgccattttcgggcgtttcgttttgtcccggtcaccgccgcagccgacgacgacgaaaagcttgccctctgtcatgtctttgcatgtattcaggacgttttccagactgtcaggcgtgtgcgcgtaatcgacgactacaggaaacggctgattatgatttaccagttcaaaccggcctctgacaccttgcagctcttcaagagcgcttgtgatcgtatcaaacggcagacccgctgcgatcgctgtcgccgctgcagccagtacgttatacacgttgaagcggccgacgagtgaaactgtgatctgctttgttccttttggcgtaacaagttcaaagcttgtgccttgcgcagagatctcgatttgtttcgccatgacatcggcatcattctcgattccgtatgtaaggatgtgcgccgccgtcactttttcaaaataagcactggctttgtcatctgcgtttaaaacggcccgcttcggcttttcgtggttaaaggagccgcccagctgggaaaacaggaggcttttagcctgtctgtagtcttccatcgtcttgtgataatctaaatggtcctgcgtcaggttcgtgaatacggcgatatcataatcgcagccgtgaaccctgccgagtgacagagcgtgagaagacacttccataatagctgtgtcaacatgctcatcattcattttcttgaacgttttttgcagtgtgacgctttcgggcgttgtatttttgaccgggaatgtctcatccccgattttaatgtacatcgttccgattaaaccggtctgtcttcccgcttttttgaaaatctcatcaaccatgtgcgtcgttgatgttttgccgtttgtgccggtgatgccgataagctgaagctgctttgtcggctgcccgtaaaacgcgtcagaaagaacgctgagcgcccgctgtgaccggcggacaataatgacaggaacatcgacgtcaagctctttctcggcaacgatggccgctgcgccgttttctgcagctttttgggcaaaatcatgtccgtctaccgtatacccttttatacacacaaaaagactcccttttctcacttccctggagtccatctcaattgaagttatgtcagggtcatgaaagtcattttgaacaggttcggccattaaatatgtaagcagctttgtaagtttcattgtatcaaacctctcagaaattctattcattcttttatcatgataaccgtttataaaagtcagaatggcttttaaacatacagttcatattttagcgtaaataaaaggatacatccagttaatcttaaaagttatcttctttttttctctttatgataagaggcagccgaaaacaatcggctgcctcaaaaagactcattcttcactcaagtaaacacggatctttgagccttcttttactttcgttccggctgcaggtgattgtttcacaattttgcttccttttcctgaggagtcaatattcaaattgacaagcagcgactcaagatcagagacagacatccctacaacattcggaacctctattgtttttgtgtcgttccattgatattttttctcgatttgattttttcgcggtttcacgccgagctcaggcagactgtctctcatcatatttccgacaatcggcgcggcgacggttcccccgaattgaatcgtgcctttcggattatcaaccgcgacatacacgacaaggctcgggtcatcagccggcgcaaaaccgataaaggagacgatatggttgttttcgagatatttgccgtctttgaccttttgtgcggtacctgtttttccgccgacgcgatatccttccacaaaggcattccgccccgttccctgagcgacgacgctttctaaagcatatctgatctgctttgacgtttcctgggaaataacttgccttttcgcaatcggcgattgtttcttaacggtttttttcgtaacgggatcaacccactctttggcgataaatggagtataaagcgttccgccgtttattgctgcggaaacggctgccacctgctgaatcggcgtgacggaaaccccttgtccgaaagcggttgtcgcctgttcgaccgggccgactctgtcaagcgggaataagatccccgttccttccccttgcagatcaatgcctgttttctttccaaagccgaagtccttaatatattgaaacagcttttgttttccgagccgttcccccagctgtacaaacccggggttgcaggaattttgaacgacttcaagataagattgcgaaccgtggccgccctttttccagcatcggaggcgggcgccgtcgacctcggcaaatcctttgtcataaaagtggtctctttgcaagtttactttttgctcttgaagagccgccgcaagcgtaataatcttaaaggtcgaacccggttcatatgtgctccataccggcaggttccggttgtaaacagacggatccaccgattgatagtcagccggatcaaaatcaggacggcttgacatgccgagcacttccccgtttttcggattcattgcgaccgcaatcattccgtccgggttatatttcgccgctgcattgtcgagctctctttctataatcgtctgaaccttggcgtcaatcgtcagtttcatatcaagtccgtctttcggaggggtgtaatcatccgcttcatcaggcattttcttccccttggcatccgtataaaatttcacggatccctttacaccttttaagtcatcatcataataagcctccaatccgagaaggccctggttatcaataccggcaaaaccgagaacatgggacaaaaagcttccgtacggataatggcggatgctgtcttcagccacataaaccccttttaagtcgagcgctttgatttctttcgcttttttattggaaattttccgcccctcgggtgagattttttctatggaggttttcttagtaatgtgtttgtagaccttctcttccgacatatttaaaactgacgcgagaagcttgcccgtttttatgggattttggatctggcgcggtacgacaaagacggtcggcgcgcttttattagtagccagcttcacgccgtttcggtcaagaatctctccccgctcaggctcaaacggcaaatttcggctccaggaatccttagccagtgaagtcagcttttctcccatcacgaattggacatagcctaatctgctgtcaatgatcaaaaaaatgattacgccaaaaagcaaaaccagtaataaacgttttcgaaccgttacatttgaaacgcgcaagggaccgtccactccttatttaggcttgtttcaatttatgcctcagcttggacacatagaacggcggcgcataaaaaagaagcccgcgggcatccgcggacttctctgtcccgttaatcaggatttttaaatttcaccttgatcacggtattttctttcagttctttgccttttttcacactttggcttgaagcgtaaccttcaccgctcacatcgatgtgaatgcctgatactttgctgaattgaagcacttcccgtctcgaccatccggacatatccggcatcgtcatctttccgtctgtttttaagaagattttctgattggtgatcagatcttctccggctgtcggatactgctcttttacggcaacatcgctgccgatgacaatcggtgtgagatgttcatttttcgcttccttctcagcgctcttgaccgtcttatctgtcaggtcaggcatcttttggcttttcgtttcttcctgaccggaatctgttttttccgtcggttcgatattcatgtagtgaaggctgtttttcatcgtcgggttaaagatttccgcgacaggatcagagctgctttgccccgcttttaattgcggctgctgcacggctacatagatgacgagcttaggatcatttttcggcgccatgcccatgaatgaaaacacatagttgctcgttcctcttaaatatccgcccgtcccggcaatttgtgcggttcccgttttacccgcgacgtcaaatccttcaattttataaggttttcccgttccgatgtctgacgtcacgacttctccgagcagattccggacttttttcgccgtatcggctgaaatcggcgtgcctgcttgctctggttttgtctgcttgacgacttttttcgtatcggggtcgacaatatgatcaatgacgtaaggtttcatcattttgccgttattggcaatcgccgtgacggcctgaagctgctggatcggcgttatcgccgatgcttggccgtaagccgtagacgctttgtcaaaatcatatttgtagttaattttacttgatacttcaccgggcagatcaacccctgttttttgatagagcccgaatttgtgcaggtactcattaaaccggtcaaaccccagtttttcgttggccagtttggcaaaagcaacattggatgacctcataaggccgtcatggaagcttgtcatgccccagccggcgccatcgttccaatctttaacaggtccgcctcccactttatatgttcctgatttatatttctcgtttgcggaaaacacattttcctgaatcgccgcagcaagcgtaaagatcttcatcgttgaacccggttcatacgcgtacgacactaagtcgttgtaataattggtgacgtttctgatattcgggtcaaaactcggacgctgccccatcgcaagcactttgcctgttttcggttctacgacagccgccataatttttttcggtttatatttttccgctactttcgtcatgctgtcttctaaaaaggtttgaattttctgatcaatggttaaatatacattgtcaccgtttttaggtgcggtgattttttctttgctgttcggaagtttccagccggatttatcactttcgtaagtgacggatccgtcgcgttccgtcagatagttgttcagtattttttcaagccctaaagagccttgtatctcgtttgttttttcattcacatcggcatagccgagaacatttgacaaaaatacaccgttcggatagtaacgcttcgtatctcttaagaaagaaatacccggaagattcattttttcgatcttttgttttttcgcataagagatatcgcggccggctgaaccgaattccacctgcttcgcgccatccctgtttaagatgtccagaatctcgcttttatcaagattgataacggtcgccagtttttccgccgttttctctttgtctttgacatgctgaggatgcttcttgtcggtcgtcatctttttatcaagcacggcaatgagcttatatgtcgccgtgtcctctgcaagcactttaccgttccggtcaagaatagagccgcggctcgcttctatcgtccgctttttttcgtgctgctcggtcgcttttgttgcaagttctacaccgtttgctttaccggttaattgaatgtacgccattctcccgagaatgacaaagaaaaagagagcgaaacaaatactgagtatcgctgctcctctgttcataaacttattttttttcggcatgggttatcattcctgtatgtttttcacttttttatctttcagattcaaaccgtgctttttggcgatatccatcaggcgctgcggctggcttaagtcagcagccgtcttttcgagatcaccgatctgcttattcttctcagatactttctcctccagtttttgcacctcaatattggattggtacgccgcgtatgcctttgatacgataaacattgatgtggagagaacggcaatggcaaacaggacgagcagcaccttttccccgagtgtaatggaagccctctttttgacaatcacctttttttcgggacttatcactggccgttgttgtttttcctgctggtaagctaagttgctcataggctgatgacctcctttaatgttgtcatttgctgcccgttattttcgtttctccgcaatgcggagcttcgctgaccgggcgcggttattttcttcaagctcctcttttgatgccgtaatgggctttcttgtaatcagctttaattccggttcaaattcttccggtatcacaggaagacccggaggcagttcgggaagtgatgatttttccttgaatgtcgtcttgcacattctgtcttccagcgagtgaaaagtgatcacagacacccttccgcccggcttcagcacctctatcgcttgcaagagggcctcttcaaatacttgaagctcgtcgtttacggcgattcgtatggcttggaatacacgtttggccggatgacctccgcttcttcttgccggagccggtattgcgtcctttattagatcgaccagttggccggttgtttgaataggcgatttttctcttgcctcttcaatttttcgggcgatctgcttgctgaatttttcttctccgtatttaaagaaaatcctcacaaggtcctcataccgccattcatttacgacttctttcgccgtaagggcggccgactggtccatcctcatgtccagcggtgcgtcatgatgatagctgaatccccgttccggtgtatcaagctgcggagaggatactcctaaatcaaataaaattccgtcaacactcgtaatgccgtgttcatgtaaacactcttttaaataacgaaagttgcttttcaccagaatgagctgtcctttgtattcggacaatgttttctttgcgttttcaagcgccgtgtcatcttggtcaaaggcgatcaagcgtcctttttccgataattgctgcaataaatatgtactgtgcccggcgccgccaagggtgcagtccacataggttccgcccggtttgatatttaaaccgtcgacggtttcacgaagaagtactgtcttatgctgaaacatttgtgtcggtcccacctttatcaggaatgaattgaattgtcagttgttgttgtgatgcacgaagatccattatatatcaaatccaatcatgttttcagcaatttcagcgaatgaatcttcttgctcttctgtgtattgttcccatattaccttactccacaattcaattcgattggaaaccccgatgacaacacattctttttccagttttgcgtaattcagaagagatgacgcaatattaacccttccctgcttgtccagttcgcattcggtcgcaccggaaaaaaagaatcgggtaaatgcgcgggcgtcttttttggtgagcggcagagccttcagcttttcttcaatcagcttccattcattcatcggatagccgaaaaggcattggtccagtcctctggtcagcacaaactgctcaccgaggccttctctgaattttgcgggtacgatcatgcggccctttgcatcaacagtatgccggtattcacccataaacatgataaggacccccactttctcccctaaactcaccactatccgccacttctctccacaacctcattttacactgtttacacataaaaaaaaaccctgaactattcagggttctttaaaactttatttcaaagtttgacaatctgatgttggttttgaaaagaaaatggcagatgtttgaaggttgtgaagaattttggaccgtagcggttcagataatacatcacattccaaatccgttcctgcggagcgccgagcggtctgatgctgttttggattctttcatagtcacgcagcacaaagccttctttttcttcaattcttttcattaccgtccgttctaaaaacaagagctgatcttgaatgaaggcggcattcttctgtaagagcggctcaaggcttgaatcgaccttcagcgcttcgtcccttgcgcgtttatggacagcttcaatctgcgacttcgcctgttccattacagaagaaaactcttccggaatctgctcttcaaaataagtgtctttcaggtgtccggtgccgtgttcgatcgcttcctgaagcgggatattccgttctgaaagcttcttttcaatatggcgctctaaaatcgtaatgttcagtctcggcactaccggcgtcatgcgaaagcccattaatgagaaagcccgcttcagctcaccccaataattgatctcccccggtcccgcgataaacgccagagtcgggatgagaaactcctgcatgagcggccttgtcacaacgttattgctgaaacattccggtttttcttccatatgggtatgaagctcgtcgttcgtccacttcaggtcaagctccttaatgacaaaaacgccgttttctttttcaattaagaaacgctctccctcatgttcgtaaaacagattggcctgatctttgtccgattcaataatcgggtgataaccggcttcccgcataaaacgctgctggtctgacacggctttggcaagctcatgattgtgttttaaaatctgctgaaacatacctgtttccagctttttaatccccggatctcccgaattcatcagaataaggccttcttcttgaaacaagtcggcgatcaacagctcaaaaaagtccgtgaatgtctctgatgagcgtaaacatcgcttcacgttttgaaggagtgcgtttgtgtgatccgtctcctcaaaagcagcgaacacttcatcaatccaagccgcgcatttttcctgatcaagctcggttttagccgccgatgtttttttccagtacgactgcggcagtttctgtttcaccggacctttattctctgttgacgtgtgcacaaaattgatttcttccagatcgtgatcttcacccgccacccagaaaatcggaacgacaggaatctgcaacgcctcttcctgctgtctggcaagtacgataatggagataattttatgtatggtgtaaagaggccccgttaaaagaccggcctgctggccgcctactaccgctgcgctttttggatctctcagtttttcgatggaggcctgcatggcggcggagtaaaatttttcgtgataggaggataaataatccgctaattcctctctggcaaacggccgcgaagacaggtcatgaagccgcttttgccatacgtcctctgaatgaatatcataatcaaaaaatgaagacatgttttctccatctatatagtgctgcacaaacttattttgacttttgatggaaagttcagttagctgcatctgtctggaacttcctttctccaataaatagttaggtttccgaaatgagtatagcatgttaccggaaaacctcaaaagactttgtttcagtttctttctaacgcttttatgctgcggtgtaaaaacgtgagatgaacggccggcaatccgcggctttccgcttcttttacaaggtagccgataatcgcatcggcctctgtccgcctgcctgccatgatatcgacgagcatggaagaatgatttttttccgtcagtctgcaaacttcgcaaaccttgttccacgctttttctctatcggcgaggccaagtattgtctccgcttcttcaaacacgtttctcatatactttttgtaagcgtcatttcttaacagctctccgtttttcacgcgcagcaatgcagttaacgggttgatgcatacatttatgatcagttttcccgttaaaagccgataccagtcgttttcatcatatacgggaaaatcccggtgcatgccggaaaagatgcttttgagcgtttccggccgggatgcgctgaatacactccatcttacggctcccgctcccgtatgttcaacggcatgatctgatatcttttttgctccgtgctcaacagtgccgacataaagcgaatgatccgtatgccaatctttaatgtcgtgtatgtgtcccatgccgttttgcaaaaacagcacattcgtcccttttatcgtctcaagatcccgcaacacagcacttagctggtgctgtttaacggctgcgattaagaggtcgaatccggaaatgatgcctgtttgcgctctgcatgccgccgtacattctattccgcctttcaaaagccgtataccgcctgagttaatcgcatcagcctgctccgtccgccgcgtaatgaccgttacctgatggcgggacgataagtagtaagcacataaaaggcctaccgctccgccgccgataattccgattttcacactgtcacaccctatatctgcatttttccatattatcatagcagaagccgccgcaaattacttcaatttcgttttgagcaaaaagactggcaagcatattatagttggaattttcaattaaagcgtttacaataatggtagaacacaacaaagggggagtttgtgttgaaaatagagcgactgctcatcaactttaagacactcgaagaatttaaaaggtttaaggaatacgggatgcaggagctgtcgatgcttgaagatcttcaggataatatcattgaaaatgacagcacctcgcctttttacgggatttacttcggggataaactagtggcgagaatgagtttatatcaggtaaacggaggcacgaatccgtattttgatcagcgtcaggactttttggaactttggaagcttgaggttcttccgggctatcaaaacaacggatacggaaaagcgcttgttgattttgcaaaatccttcagaatgccgatcaggacgaattcacgcatgaaatcagcagatttctgggataagatgaattttgagcccgttaaatatgatatggcgcgtgataaaggagaaaatccttatatctggcatcccgatatggacggtgaaatgacatccggagaaacggcataataaaaaaccggccgggccgccgcccccaggccggttcattttacaggctctgcgccgattttctgtcgtcttcttttgaattgaccatccttctcgctctgtccataatgtcaattaacgctttataatcttcttccgtcatctccagcttgtttctcaagctttcattttcctcacgcagatcctcgacttctttttgcagcgcggtcagctgttctgtgagtttttctttttcatgacgcacatccgctgcggctggcgactctttaaattgctgcagaaacaaaatgacatcatcaatggacagctctttttctccttccgccctgcggatcggaggctgtttgacggttcccggcagattggcggaatgcaccccgatctgctttcttaattccttccgctgttttttcgccagctctatccctgactgatattgttttctgacataagaattccatctgaacccgcaggcggcagccgttctcgtcagcgctctgccgacttcttcaaaagcggaaagctgggtcccgccttcccgaatatgcctgagcaccacttcggccagcagcaaatcttcatcttgcgtccacgcgtcttgtctcgttatcgtcaatcgtatctccctccatatttgctcatttacctcatacatatgccgctgatagattagatagactactggggctcacaattttttcggcggaagcaggccggaggggcaaaaaaaagaaaagcgcaggaaccgagattcccgcgcttttcttcatacattaattgcttttaacatttatgtctttgccgttgtatgatccgcatgctttacatacacggtgagacaatttcatctctccgcatgacgggcattctgtcataccaggtacatttagtttgaaatgtgtacggcgcaatctttttttcattttagaagttcttctaaaaggtacagccattattcccacctccttaaagagttaagattcatcatcttgtgttaagagctttttcagatccgcaagtctggggtcgatttgatttttcttgtcttcctcagaaatcacttgccaatccttccccacttggggagcggctccttctttttgttcagtttcacaaaagacttgcataggaatttctaaaagaatctcttcttttatgatcggagttaagtcgacggtatcgtcttcagcaaaatgaacgtcctcatcttctatatcatccgacttatgaaatctaaacagttcttttgtcgcgattgtaaatggatacggcacatcaactaaagttcttgagcacggcaaaaccatttcgcctgaaatcgtaaagtcaaacgaaacttgcttggattcaatctccgcgcggcccttcacccggacgggagaaatgcggcggatgtcagaattcaattttgtcagctcatttaactcaactgtttcatcaaattcaaagctctttttcgccatttgatgaagctgataaatcgtccatttcatttgtatcacctcaggaaagcaacaaacatgattatagcttttcagaatgtttttgtcaatattttttctttacagcataatgccgccgtcatgcaatcgttgacagccggataggctatgcatacactaaacgaaacggactaaaatatgcacttcatttgcaaatgtaccacacgaagcaaaacatagcaagaaaggcgggacaaatatgaaagcagtcggcctggttgttgaatataatccctttcataacggacaccgctatcatgcggaacaagcaaaaatcaaaacggacagcagcgtcgcggcggcggtgatgagcggcccttttttgcagcgcggggaaccggccgccgtctcaaagtggggccggacaaaaatggcgctggaaaacggcgtggatatcgtcattgagctcccttatatatatgccgtacaaaaagcggaattattcgcgcgcggcagcgtttcgcttcttcatcatttaggatgcagcagcttgtttttcggcagcgaaaacgggcggatcgaaccctttattgaagcgtctgaagcgttcagccgaaaggaagatgactgcagcctgattctgaaagaggagctgaaaaagggtctcagctatccggccgccgcctcaaaagctttttcacacatattcaaagggcgggacatgctcgatttgtccaagccgaacaatattctcggttttcactacgttagagcgatacacacctccggttccgctatgaagccttatacgacagccagaatcgcttcccaatatcatgacgccgagcttcccggagataacagccggatagccagcgcaacaagcatccggaaagcgctgatagaaaaaggaacggcggccgtaaggagctttctcccggaagcgtctgcgcgtgagctggaggcatacagaaattcatacggcatatggcacagcacggaagactatttttcatatgtaaaatacagcctcagcactctttccgctgaagaattgagccgaatctatgaagtggaagaaggccttgagcacagaattctgcgcaccatcagacaagcccgatcctatcgcgaaatgatggaacgattgaaaacaaaacgatacacgtggacgaggctgcagcggatgaacacgcacattctgacacggacgaaaaaagaagacatgcatcggctcttgcagccttcaagcgctccttatatccgtcttctcggaatgacgaaaaaaggacaggcgtacctgtcggcaaagaaaaaagagcttaccgcacctctcgtcagcaagctctcttctttctctcatcccgctctggatctggacatactggcgggacgggtttacagcctgccgataaacgaacctgaacgcacattgtttgagaaacaggaattttcacaagcgccgatccgctatgatgaagacgaaaagtgttttttgaatgcgtaaaaaaagcacctgtctgtatcaggtgctttttactttcagctgatccaaatagtcaagtgcgtcctgcatggtgtcgacagggacgattttcatatcggacttgatcgctttcgccgtttttaccgcatttttgtaatcagaattttcagctccgttttgattcggcgcaaagaaaatatcttttcccgctttgtctgcggcgacgactttctgatcgattccgccgatcggtccgactttgccgtccacgtcgattgtccccgttccggctatattatagccttttgtttcgtcaggttttgtcagctggttgtaaatttctaaagacatcatgagacccgcagaaggcccgccgatgttttcaatgctgaaatgaagatccggcttcactttcacgttccggtccgtatataatgcgacaccgattcccgctcttttcgggtcgtccgggaatgatttcagcacaatgtcaacggtcttttctttcgtgtcccgttcaatgtgaaacgttactttttcccccgcttttttgctgctgatataatcaatcagcttttcagcggattcgtatgttttcccgtccgcgctgatgattttatcaccgacctctatttttccttttgccggcatgtcagagacgactgagctggcataaatgccgttaaatgagtatttcacctgtttcccggctttttgataagcggcaatgaccgcgttttcttgggagcttttcatcatttgcagctggcgcttcatataatccgagtccgattcgccctcttcttttatgctttcatcagggacgatttcttcgtaaggatgcactttcgcccaaagatatgtatacggattggcggggcctactttgacagtcatcaaggaaaggcttcctttttcaggatagcctccgtccaccttaatcagcggtctcagctctgatgcttctcccggctgtgtgatgtaatacgggagcttaataaatgtaacagcgattaataagatcaggatgataaacacccagcgaaaatgttttgctttcatatgagttagccctcccagttctctatttcttgtttaatccggccgatcatccggtctgcggcttcttcgcccgctgtgatcatatgatcaatgttggcaaaagaacttgagctgaatgattcaagagaagggcggatcatgacgtctgcggcaatggtctggtgacggaccaattcattttgcagtatatccatactttgcatgattacatcaaaaatatgtgccgccttttccgtttttttcacccgggatacgtcagaggcgatgacgatatcagcacccatatcttttacggcggaaaccgggattctgtcgaccaccgcgccgtcgactaacatacgtccgttcattttttgcgggacgaaaacgcccggtatgctgatgctcgcgcggacggcttcggacactgaacctttcgtaaaaacgagtttttcgccggtctgaaggtcgcaggccacgatgccgagcgggatccgcagttcttctatcggcttgccgtacgtataggcatgaacgagctgcctgatgcggtctccttttaaaaatccgagcttcggcatcgtataatccgcgtacagccgccgcttaaatgctttagcgacttttttcatcgtggccacgtcatgcccggccgcataaaagcttccgactaatgctcccatgctgctgccggcaatcatatcaattggaatctgatgcttatgtaaactggataacactccgagatgagcgatgcctcttgcccctcccgaacctaacgctaacccgattgtaggtttggccaacgcgacgaaccccctaatagacatcctatacatgaattctatggtctaaattgaacccctatgctcgtatattagtacaggatgacaaataggtacttgcccggccgcctttaaggtctgttctatattttatcatgatataaatgtcagtgtgcaattttagcatcggggaggtaagaatgaatttgtctaagtttcatacatttttgatttcattgtttttcatttttttgacggctacggttatttcacaccctcaggcctcattcgaagcctccaaaaccggtctttccatgtggtgggaggtagtttttccttcattgcttccgttttttattctatctgagcttttaatcggattcggcattgtcaagtttgtcggccttttactcgaaccctttatgcgtcccattttcagagtgccgggggtcggcggatttgtactggctatgggcatggcttcaggcaatccggccggcgcgaagctgactgcacggctgcgccaggataaacaaatctccagagtagaggctgaacgcctcgtctcttttaccaattcatccaatccgttatttatattcgctgctgtggcagtcggcttttttcataacgcgtctctcggcattctgctggcatcggctcactatctcggaaacatcgccgtcggcctgacgatgcgttcatacggacggaaagaagaagcggcgtataccggtaaaaagacgatcgctctcccttctctgaaggaagcatttctggccctccacaaggcgcggctttcggaaaaacggccgctcggaaaaattttgggcgacgccgtcacctcttctgtacaaaccttgctgatggtgggcggttttattatattgttttcggttttcagccggttattatcaatcgtacaagtcatggatgtgctttctgtatttacaaacgcgctgctttcgctttttcatcttccggcaaatctggacatccctcttatcagcggaatgtttgaaattacacttgggagcaagctggtcagtgaagctgatgccgccttgctgccgaaagccatgattgtgagttttattctcgggttcagcggcctttccgtacaggcccaggtagccggcattttatcggaaacagatatccgctttaaaccgtttttcgcggcgcgtatccttcagggcatttatgccgcactctttattctcttactgtggaagccgctttaccttgcgttggacaaaccttaccagtccgtattcctccctttccgcgatcaggacgcaggatctgctgccgtcagcggctggaatacacttgttgaaaccggtcccgccatcacgctgacagctctcgccgtatacgcattgatttattgttacaggctgtcagcacggacaaaaaaaggatgagacgccaatcagcgcttctcatcctttaaatttctgcatcagcgcctgttcaacttccggaggaacaaactctgaaacaggcccgttatattttgcgacttcttttacgatgcttgaacttaaaaaagagtactgattgttcgtcatcataaaaaaagtttctattgattcgtcgagcacgcggttgacggaagtcccctgcatctcatattcgaagtcagaaacggctctgagccccctgataatcgccttcgcccgcttttttttcgcatagtcgattaacagtccctgtgacgtctcgaccgtaacattcggtatgtcttttgtcacttctcttaacagctcacatcgttcctcaactgtaaacagcggctgcttagaagaattattgagcacgcatacgtacacctgctcaaacacgtttgccccccgtctgataatgtccagatgtccgtaggtaacgggatcaaaacttccgggacatacagctatacttgccacatcattaccccctatttcggtatatcgtcactcctgtaagcccgtaaatttcccttcttgttacagaaagcgcgccgacggcttcaggaagcgcaacggctttatcatgctcggctacgacaaaaccgtcttcattcagcatgttctgctcatcaatcatttcgataagcgctttcagcttttgttccttatacggaggatctaagaaaattccgtcaaaacctttttcccgtttcgccgcggcatagagggcccgctctgcatcattgcggtatacttccgctgaagacagcagatcaagcgctttgatattcgcttttaccgtttggatggctttgaaatcacgatccacaaagatacagcggtcaaatccgcgcgacagcgcttcaatcccgagaccgccgctccccgcaaacaaatccagccccgttcctccgtcaaaatacgggccgatcatattaaaaatagactcttttactttatccgtcgtcggccttgttgatgtgcccggcacagcctttaaggctcgtccttttcttgaaccggaaattactctcattattcacaccactttttctgaaaactttgatgtttctcatcggctgagccgttatgtatcaaaacaatccctatcttatcataaagcattctttcaaacaatgaacgtgaaaaacgtgtatacatattcacattcctgtcaagactacgtgtaacagcatcaatgaatgatgttgttgccaaccgcggagaagacttacgtttccccataagttcttcctccggtttctcctctcccttttccttctccttaacttgttaaggaatagaaggaccccgcaggtatctgcggggatttttttatatgccgattttataatcgtactctttcgctttatcaagctttgattcaaattccagctttaaaaaaggtttataagaaggctctaccttcttcacatatgaataagaagaaatcttttccattgttttttcgattaggtccatatcgcaatacagcacaacgtatttcagccgcttggaaacataatgaacgttgccgaattttctcagcattttgctgtgttttaaggaatgcagatatacgattatgccttggcgcttattttccatcatgatcacccgcctgactttctgttcattttatgtaaaagacgagacggccgtctcgtcaggaaactttgcatccgcagccgccgccggaaccgcacccgccgccgcaggatgacaggccgtcaaaataaggattccccgtcggaacttttacatgctccgagacggccgttccgagttcaatgctgatctcgtcaagcagcgactgaagctcagtctccgcttttttaaattcggccaccttatcgtttaaatccagttcccgtttcatttctctcatttttcgggaaatctctctataatcaggatggtatttgccaaagcgctgcacatcctcatactgctctttaacgctcataaaagaacgaatgatccgccctgcctcttcatcttcacggagacgcttgtaacaatcgcggtaattttcagccgtctcagactgcagaatcatgccggcaagctgctccgcttcactttgaagcttgacggactcaattgttgcatacataaatacgcacctccagttgctagtttaccatgaaaccacccaattggaaaatgcggcgtttaaacgctttttaatcctgtgaacgcatggcgtgaaccatctgcatcatcatctgcgccatttgaatcccgtttgagaattggcttacccgatgcggtatcgtcttttcataaaaattcatcatgtcaagctgaaaggaattgagatcgtccggttttctcgcaagtctgcggtaccagacgggacgctgccgtataaaccgtttccgttcctcatctgcggatatgaattcctgaacctcttttcgcatacacgatccccttctttaatcctttctgaacgaaaaaggatgttgtccggagccttgccggggctgcttcgtgctgctccccgaaaattggcttaaaaggctttgcaatgatgaaatggattggctcattttattgatctgctcattcatttggttgatatccatctttttgacggcagtgaccatttttgaaacgaaatcgtttttttcagctggttcctgtttggtttccgcgtcggaagaaggctgaacggcctcgtctttaaaagggtcccatatcggatcatcctcgcccagaagaacccaattttcatagacttcctgccagcttctttgttccttgcgaacattttggatcagtttgggatgcttttttacgaattgtttaaaatcatcgattgattgccgtgattgctgattcgccacaattctcaccccctccgaaaagttttgcctgctataatgtatcggttcatgcgccttaatgttcgcctaaattgagaaaaaaagcaggtatatataaaaattgtttttttcgccaggagcaccgctcgcgaaaaaacataaaaaaaccgcgggggacgcgcccctctgcggttttttactgccaaggcttaatgaagttttgcgtataatacttctgatcaacgccgacaccgaggtgcgtataatccgggcttaacagcgcctttctgtggccttcgctgttcagccagccctccacggctgcaggaccgtccacatagttgtaggcaatattttcaccggcctcccggtatttcacatcgcctttttccaagcggtccttcagagtcccgtatttctttgagacgtgagagaaatacttgttatccttcatgtccttgctgtggccgaatgccacttttgcggcgccttcgtcccatttcagccttgcaagtccgtgttttacgcggatgacatttgtaatatcgagaatctgctgttcactcgctcgttcaatatcgttccattttttatcagaaacaggctcgggttctgtcagctttcctctgtacatgacttcatacggcctttgtttcacaagtgtttccgcatcaaatgccctgatgcttgacagattcccgtcaaatttgtccatgtacagctgaacatacattccgcctatcttgacggtgggacgggtattgatatcttcttcagaaaactcgaaccgatacgtgtttcccttgtcagtcacattgacaaaaggagaaacctgcgtcgttttaaaaacttcgccagtcgattcgccgatcttaaacggttttgcgttgatgccgcttcccgaagcgtataaagtcacggctttatcattcaaaataccgacttgtacgtattggtctttcccctggttgtacacccaccactcgtaatcgtaggcagaaggatctttccgggacggttccccaagtttctttttcacatcggcggcagatttccccatgagagaaagcagtccggatgacggcattttcagccgttttccgctctcttcttcattggaaacctgaggctcctcctgatccgtctttttctgaggagccgatccatattgtataaacagaacatacgctccgtaaataagcaaaaggataacgagagcccttgcgatatttttcaacctctcacccccatatgttcaaaccgttctgtttttgtttactcttatacagtacagcctatttgcatcgtccgtgatttatgtttaatggataaacccctccggaccgccgtcttcagaaatgtcagacagcactcggcctgcttgctcatttgattgctcggccaacgaaagatcgccgagcgtaacaatgccgaccagttttttatcccttgtgacgggaattcttctgagctgatgttcagccatcaaatggagcacctcctccacagaggcgtcttcctctgcactgataacccgctctgtcattgcgtcggttattttttgagagttcggcttttttgaagcaattccccgtaatacgagatctctgtctgtcacgatcccgacaagtgtggcgccgtcttcatccactatcggaatggcgccgacatctgcgtctttcatcttcaccgcagcttcatatacattatctaatactgtacaatattgcaagtctgacgtcatgagcttattgatctttgtcattgcggaattcctccttttttctgctactattgtcgtcaaatttttcattttgcatactttcaccgtatgaatcattgaaagtgtaacgctttcatactatgattgtcaggaaagggcatttttaaaaggagggggaaggtttgaagtttgaaaacagcggtcttgaaggggtaacagcggagctcagccgcttgaatgatctgatggaaggtaaagggctcattctggctggacaatgggattatgaaagagtgacttacgacaaaaagttttcagtacctgaggggacattttatctgcggattcaaggaacggcaaaagagggcgatgtcggcggcagccgggccgtgattcagctgaaggcccctcttttaggaaagcattattatccgcacggcgtagaatacggcagcgctgaagaatttccggaacatgtcgtcgctgaaagcaaagctttactgcttgaattggaagagtcattaaaaacagtgcaaatgtaataaaaaagtacagcatattctgctgtactttttttcatgagacggtatgctcgatatacggcggctctgacagcgtatctttttcccgttccgttctgacccactgaaaaaagatgacagccaaatatgttccgtagaccgcctcttgaatgattttcatcagtactgccccaagctgctgatcttccagaggagggagcgtgttaaacatctccggtccggataaagggatctcctccagcaaatctaaaggaacgcaaagcttcattgcttcggcccaagccgccggatctgtatacgtggcatacatgggcgccccgctgaacataatgagcgcgcaggccggcgttaacagaatcccgtctgccataatataccccagcttcattaaaccgctgagacggggcagaccgtccaccttatgcacaagcggccaccacataaaaaacgccgttacaaagatgagtccgttcatcagcgtgtgatacagcgaatccgttttgacgaaatcaaatataaacgggatgtgatacagtgaaaaaataccgttaaacagcactaatgcgataagcggcattgaaaagaacgaaaacagcggctttacgacaggacggaagatcagttttttccatgcccagccgggaattccggaaatcaacagcggcggtacgactaaaaacagaaccgccatctgcgtcatatgggcgctgaacatcacatggcccaataaatcaaccggacttcccgcagccgcgtaaaaaaatagcgcggaaagcacaaacagcaccttctccttagcggacacacgtcctttatgccggctgcaccagtaaaagtaaacacctgttatcacggcagttatacaaaacagatatgggctccacattgcgcgaaacccgaacatttccaaattaatcaaatctctcactccccgccgccccgattaccaccaaataatcgtgacaaatgcaagcacggtgataaacgcgacaaatattcccgaatacagaaataatgacggcgcttcatgccccttctggctcatatgcataaagtaaaacagctgaaagatgacctggatgaccgcaagcaggatcagaaacggcatcgtaaaccatccggcaatgccgtcagcagccaccgtcaaaaacgcgacaagcgtaaggccgatcatcaaaccgaaggatatgacctgatatttcatctcctcggcatttttcttttttcgatattcgagatccgtactgacagtccctctgtttttgttatcgtccatcgttatcccaccatccccatcaaatatacaacggtaaagataaagacccacacgacatcgataaaatgccaatataagctggccacataatatttcggcgcattataaaggctgagccctctttttgcattccggatcatcagcgcgctgatccacaacagcccgaacgccacgtgtgctccgtgtgtgccgacgagcgtgtaaaacgctgagccgagcgcagagcttgtaatggtaaagccgaattcgtgagtgtaatgcataaattcatagatttctacccctaaaaatcctgctcccaataaaacggtaaccaaaagccacacctgcatttttttaaaggagaaatttttcatatgatacatcgcatacacactcgttaagctgctcgttaaaagaagcatcgtcgcgataaatacgatcggcagctcaaacatctcagccgttgacggccctccggctttagattcccgtaaagcaaggaatgttgcaaatagcgaggcgaacagaaccgtttccccgccgagaaacagccaaaatcccaaaaacttatttttcccctccagcgttgctttttcaggagaagccggaaaggtttcagccgtcattttttcctgcagctgcattacgccttcacccctttatcatcattcggcagatcttctttgtgaatatgatagccgtaatcatcgaccacagagcgaagcagcatggtaaagaatgtgatgccgagccctatgaagataaccggaagcccccatgaataatcggagtggtataaaaacccgaacgctgcgacaaacagcccgaaagatatgataaacggcatgatggagccgttcggcatatgaatgtcctctacaggctctgcaggcgccatcccttcatttccggcctgcttttcaatccacagcgggtcaagtccccggacaaacggaagctgtttaaaattatattccggcggcggcgaagagaccgcccattcaagcgtacgaccgtccagccacgggtcgttcccgacgtatttcccctttattgaggtataaataatattgacgacgagtaaagcagccgcgcccgccatgaaaaacgcgccgattgaactgatcaggttgccggtatcaagcccctggccgggcagatatgtgtaaacgcgccgcggcattcccatcaaaccgaggaaatgctgaatgaagaaggtaagatgaaacccgataaaaaataagacgaacgaaattttccccatcgtttcatgaagcaccttcccgaacattttcggccaccagaaatgcacccccgccaggatgccgaacacaacgccgccgataatgacatagtggaaatgcgctacgacaaaatacgtatcgtggaactgataatctgccgctgcggccgccagcatgacacccgtgactcctccgagtacgaaagaaggaataaaggcgacggcatacagcataggcgtcgtgaatttgacatttcctccccagatggtcaaaagccagttgaaaattttaatgcccgtaggcaccgcgatcgccatcgtcgcaaccgcaaatatcgcattagcgatcggtccgagtcccgtcgtaaacatatggtgaacccaaaccatgaacccgagaaagccgatcagcacgatcgcgaagaccatagacgaataaccgaacagacgtttcctcgcaaatacgggaatgatttctgaaaaaatcccaaaggcgggaagaattaaaatgtatacttccggatgcccgaaaatccaaaacagatgctcccagattatcgtattgccgcccaattcaggattaaagaaattcgttccgaacaaacgatccagcatcatcagcgccaaaccgacggtgagcggaggaaatgcgaataaaatgagtgccgacgccacaaatgtcgtccacgtaaacagcggcagtctcatatacgtcaaacccggcgccctcatattaataatcgtggcgagaaagttgatccccgcaatcagcgtacctaagcctgatatttgcaggccgagcacgaaaaagtctatgccgtgccctttcgaattcagcgcaagcgacgcgtacgacgtccagcctgcatcaggagcgcctcctaaaaaccagctcagattcaaaaagatgcctccgaagaaaaacagccaaaatccgagcgcattcagaaatgggaacgatacgtcacgcgccccgatctgaagcggcacaaccgcgttcatcagcccgaataacagcggcatcgccgccaggaagatcattgtcgtgccgtgcatcgtcataatttcattaaactgctgagcacccataaaatcgttccccggcctcaagagctgaatcctgataagcatggcctcaagtccgccgacgacgaagaaaaatcccccggcgatcatatataaaatcgcgattttcttatggtcaaccgtcgtcaaataatcccaaagcaaagagctttttctttgctgtcctgtaagcgtattcatcatttacgacctcccccctgatatctccctgtcctcacttgttctccgctttcagcccttttaaatattcatacagcgcatccgtttcagcgtccgagagcttcggataagtgcctgtcattttattgcccggtttaatgctgtccggatttttcagccaggcttttatattctctttattcgcatccttaatgccggccactttgacccgttcaccgaaggtagcgaggttcggagccgttcttgccgcttcagcccgtttatcattgggctcaaccgcatgacagctcaggcagtttttttccttaaacagctcttctccttgcgcggctaaaccggaatctgttgtatgcttataatttttcatcgctttcgtccattgtttaaattcttttgacggcagcggtttcactttgaaatccatcagcgcatgtgaaggtccgcacagctctgcgcatttcccgaagaaatattctcccgcttctttgctgcgtttagaatcgaaggtcagaaagaaagtattgtcattatccgtattcgtatcgatttttcccccggctgacggaatccagaaagagtgtttcacatctgaggacttcagcttgaaatagacgcgttcatctgtgggaacgatcagctcctgacttgtcacaaacccgtaatcaggatactcgaattcccaccagtataaattcgcccttacattaatcacgagcgcatcctctgctttacggtttttcttatccatcggcgacgtatccgccagcgccaatgtatcgatgacaaccggaatgacaagaataatcagaagcaggatcggaataacggtccaggtgatttctaaaaaacggttcccctccacctgtttcggtatcgtgtcttcccctatacgcgaccgtctgaatctcacaatgacgtaaaagaaaataactgctacgaccgcaacgacgacaaccatgataagtgtgctgagcaccgtcagatcatattgtttatcagccacttcgccggcaggcttgagtgtggacagaaacggttttccacagccgctcaataaaagcggcactaaggctaataatgataaaagacgccaacgctttaacatttcacccaaccccttttttgaatcagtacgagatgcacaagcagtaaatctgcttccagccgaaatacttcttttcctcatttcttaaaatatgagattttttacttaaaattccatctatgtataaaagcaaagccgcctgattaaacaaaaggtcaaggcggcgtttactagttgtcattgtttgttttggcgatcaaacaagctcattatttaattaaaacagcgtaaagaccaccatcgctacaaaataaatggtcatgtaattaagcgaatagacaaacataagagttgcccacttcatgatgtttttcatgcggaatcccatcagtccgagaacaagccatccgacattcagcaaagtgccgagaatgacgatcggaagacctagactgccgaggaaaaatggaagcggcagcaggcatgcgacccagacgataatctgtcttttcgtcacttcaaagccgtgcactaccggaagcatcggaatattcgctgctctgtaatcttccgtcttcttaatcgcaagcgctaaaaagtgcggaatctgccagatgaataaaatcatgaataaaacccacgcgacaacaccgatgtgcccttcaaccgctgtccagccgattaacggcggcacggcgcctgatacacttccgacaaccgtattaatcgtataacggcgtttcgtccacattgtataaagaacaacgtacgtaaacacgccgataaaaccgatgactgctgccatcacggtggtcatcaaaagcatgataagtcctaaagcaatgagtaaaattcctgaccacagcgcttgattcggctgaatctttccggttaccgtcggtcttactttcgtgcgttccattaaatgatcaatatcacggtcgtaatagttgttaaccgcacaagaaccggcgatgatcaaagaagatcctattaatgtaagaagcacggtgtttaaattgcctaaaaaactcagaccggatatatgtaacgcaagccacatgccggtaaaagtcgtaattaaattcgaattgacgattcctattttgataagcgaaaggaaatccttccatgccgtcgtctcttcaatctgtccgtctatagctgtatcgtttaaaattctggaattagccataacgtaaacctcccttacaaacctaaagcaggttttttaagacctgcaactctatcatacaagataatgacctgtaaaaaaacatcctcttaaatattaaacgagaaacaggaatttatttgtgaactttttatgaattttaccaaatccgccggtttcataataaagcggttactttatttctatcagacccatctggaataatcaaccccattatctaagaagtcctgattctattatatttttgtgaacaaacagaattgagaattgccacaaaacacatattcgcttacacttggtacgtatatcattttgtccagtttgttaagaaggtgaatgtaaaatgaataaagctttgaaagcgctcggcgtgctgacgacattcgttatgctcgtcgtgctgatcggcggcgctcttgtcacaaagacaggatcgggtctcggatgcggaaggcagtggccgctttgccacggccggtttttcccggagcttaacgccgcttctatcattgaatggagccacagactcgcaagcggtgtctcaatcgttctcgtgctgagtctcgctttttgggcatggagaaaagtcacgcctgttttccgtgaaacaacctttctcgccattatgtccattatctttttatttttacaggcgcttctcggcgcattagcggttgttttcggatcaaatgcgctcgttatggcgcttcatttcggcatatcgctgatttctttcgcttctgttctgattttgacgctgctcatattcgaagctgataaatcagacaaaaagctcgtcaagccgctcagaatcggcaggaaaatgcagtttcatatgatcggcctttcgatttacacgtatatcgtcgtttatacgggagcttatgtgcgccatacgaaatcaagccttgcctgccctgacgttccgctttgcagcaggctgaatcacgggcttccgtcccattttcaggaatgggtgcagatgggccacagaacggcagcgctgcttctgttcgtatggattcttgtcgcttttgcacatgcggtgcgctcctacaaagaccaaaaacagattcttgggggctggatagcggctcttgcctttgttgtattacaggcgctctccggaatcatggttgtttattcagaaatggccaccggctttgcacttgcccattcgctctttattgccggcctgttcggcgtcttatgctatttcttattattaatcgcccgcttccgctatgaatcaaaacagcggtacatctgaggcacatgaaaaggccgaagcattagagcttcggcctttttacatctaaaaaacctgatcgcacacgagggcggatcaggtttttttatgttcattttttacgctttttcaatttcgatcagtaaatcgcctgtctgaatcggttcaccgtttttcacatgaatctgctgtatcgtcccggagaacggcgcctgtaccgtcgtctccattttcatcgcttcattaatcatcagatgatcgcctttattcacctttgccccggtttccgttaacaatttaatgacggttcccggcatggatgccgcaatgtggcttgggtttgtccgatctgcttttaatttttcctgtacggatgatttaatgctttcatctttaatgaccacctcgcgcggctggccgttcaattcgaaataaacgacacgtgtcgcatctggctgcggttcaccgatagatacaagcttcacgatcagcgtttttccgcgctcgatttccacttcgatttcttcaccgagtgtcatgccgtagaagaaagtcggtgtgtctaatacggaaatatcaccgaagcgttccgccgttttaacatattcagtaaacaccttcggataaagagcatacgcgattgcgtcctgatcactcaattccatatgatgtgtttctttccattcttctttaatgccttcaaaagataccggttcaagcagctcacccggtcttaccgtgatcggcgtctgccctttcagaacgagcttttgcagtttttccggaaatccgccgtgcggctggccgatctgccctttaaagagctcaacgactgaatccggaaaatcaagcgtttcgcctttatcataaacatcttgttctgttaaattgttttgcaccatgtaaagcgccatatctccgacgactttggaagaaggtgttactttcacgacgtcgccgaacatgcggttgacgacgctgtacatgtctttcacctcattccagcgatcaccgaggccgactccttttgcctgctgctgcagattgctgtactggccgcccggcatttcatgattataaatctcagtatgcggagacttcatcccgctttcaaattcactgtaatactgacggacggattcccagtattgcgacagtctttccacctgccggacatccatttcaggacggcggctgtttccttcaagggcatgataaaatccgcttgcgctcggctgtgaagtcagacccgccattgagctgacggcgacatccacgatgtccacacccgcttcaacagctttggcatagagaaagacgccattgccgctcgtatcatgcgtgtgaagatgaacgggaatatcaatcgtttccttcagcgctgagacaagttcgtatgcggcttgaggtttcaaaagaccagccatgtctttaatgccgagaatgtgcgcaccagacgcctcaagctctttcgccatagaaagataatattgcaaatcatatttcgtccgggtcttatcaagaatatctcccgtgtaacaaatcgcagcctccgccacttttccggtttcacggacggcatcgatggccagcgtcatcccttttacccagttcaggctgtcaaagatccggaatacgtcaatacctgactccgctgactgccggacaaatttttggatgacattgtccggatagtttgtataaccgacggcatttgatgaacgaagcagcatctggaacaatgtgttcggcacttccttgcgaagatcttcaaggcgcttccaagggtcttcttttaagaaacggtacgctacatcaaatgtcgcgcctccccacatttcaaggctgaacagttcaggccacagggcagccgtaggattcgcgatttttttcaaatcattggatctgatccgggttgcaagcagggactgatgggcatccctgaacgttgtatcggtcaggagcacggatttttgctctttcacccagtctgcaagcccctcagcgcctctttcatcaaggatctgtttcgtaccgcttgccggcttttccccgatacctaacgtaacggtctgaggcttatcaaatgcaggtttttcttttttcccgattcccggaaaaccgttcaccgtgacattgccgatataggaaagcatttttgttccgcggtccttctgttttgggaaaacaaacagctcaggcgttgtgtcgataaacgatgtgtcatattggcccgtcaggaatttttcatgctttgccacgttttcaagaaacggaatattggtcttaatgcccctgatcctgaattcctgcaggttgcggaccattttcgctgatgcctgttcaaacgtcagcgcccatgtcgacagcttgacgagcagtgaatcataataaggcgtgatgacggcgccctggaagctgtttcccgtatcaaggcggacgccgaagccgccgcctgagcggtaagccataattttacccgtgtcaggcataaagtcattcagcggatcttcagtggtcacacgtgattgtatcgcatacccgtttgtaaaaatgtctttctgctcagggatattgacggcacggctgtgcagtccgtggccctgcgcgacgaggatttgcgtctgaacgatatcaacccccgttatcatttccgtaatcgtatgctccacttgtacgcgcgggttcacttcaataaagtaaaattcaccgcccgctacgagaaattccacggtccccgcgttgatatagccgacatttttcgcaagcgccacagccgcttcacagatttcgtcccttaattcaggctgcaaagatacactcggcgccacctcaatgaccttttgatggcgtctctgaacggaacagtcccgctcatacagatggacgacattgccttctttatctccgatcacctgaacttcaatatgcttaggattttcgatcagtttttcaacatacacttcatcgtttccgaatgcggctttcgcttctgatttggcccgctcaaacgattctttcaattcgctttcgcttcggacgattctcattccgcggcctccgcctccgagcgatgctttaataataaacggaaatccgtggacttttgcgaattgttcgacatcttttaatgtttcagccggtccgtcactccccggaataacggggatgccggctttttctgcctgctccctcgcctttaccttatctccgaacatatccaaatgcgctgacgtcggtccgataaatacgatgccctcttcttcacagcgtctcgcaaatcggatattttcagagagaaatccgtagcccggatgaatggcatctacgccgtttctttttgcgatctcaataatcccttcaatatcaagatacgcgtcaatcggttttttgccttctcccactagataagcttcatccgctttatagcgatgataggagcccgaatcttcttttgaataaacggctaccgttctgatgttcaattctgtgcacgcccggaaaatccggatcgcaatttctcccctgtttgctactaacactttttggatggattgttgtgacaaacttttctcccccttggcctaataaatatgtagtttataataaaggaatatccgtcctgtgtatacacttgttttttagagatacacagttttttccgtctgccgtctttttacccccttagacggaacgggctccctctttttcttcttttctgagtacttgacatgcatgctgacattcaccaatataccggcgctcgttaataacaaaaacattgatgaccctccgtagctgataaacggcagcggaacacctgtgatcggaattaaaccgctgacaccgccgagattgataaaggtctgaatcgcaatcatgctggatatcccgattgccaaaaggctcccgaacggatcttcacattttctcgcaatataaaaaccttttaacacgacaaaagccagcagtacaatgacaaacaggacgccgaaaatgccgagctcctctgaaataaccgccataataaagtctgtatgcgattcaggcagataaccgtatttttgaatgctttctccaagaccgagaccgaaaaaaccgcctgagccgatcgcataatacgaatttataatctgcaggcctgatgtgctggcgtatttaaatggattttcaaggctttcaaaccggctcatacgcccgggtgtcaaaatatcgtcccatttcagatagatgatcgggctgacaaggagcaatacgattcccgccatgagaaccagcctgagcagggtccttccgctgaatcccgaacacataatgacgcaaaacgcgatcagaccgataatcatcgccgttccgaagtcgggctgaatggcgataagcgcacaaataactacggtgacgatcaccggcggcgcaacccccgtcaaaagctgatcgatgtagctttgtttctttgcgtataccgcggcaaggtacagtatcagggtcagcttgacaaattcccccggctgaatggccattccgccgattttaaaccagctttgcgcgtttccggcaacatgtccgaaaacaaacagcgcgcaaagcgcagccactgacgcaagcagtatgaatttctgaatcttttgatgggcgaacactttgtacggaaaaacggccgcgatgataaacagcacaaaccccgcgatgacggcgaacagctgccgtttaaagaaatagtcgctgctcacgccgtaacgcataacggcggtaatcatgcttgagctgtataccattaccaatccgaaacagcacagcagaatgatagcgcatatcaatgaataatcgtaagattttaacattcttttaaacataacatcctctttcctgcttaaagcttacgtttaatacctatagcgtattatattttactataattcataaacaatttacgcagtttctttatagtttttcggatgaaatgcagattaagagaccgtcttacgaaaagaagatgcaaaaaaaacggtttacggttataaaaaaacccaaaccgttgaatagtttgagtttgatcatttattttcctgtaaacgcgtcatgcaaagcagacagttctctttcaagtctgtccagcagctctttgccgtcgttttcgtcaactaatcccaggcggacagcaaaatcgatttccctcgacagtccgaacatctgagtatccaagacctcttcatacagaggacattgaggcatcgttaagttatccatttgtactcggatcagcttcaaaatcttctcagcatctaacttcaacagctcgaatgctttctgctgatggtcaactataatctctgaagccaaaagtatccctccgttccccaggcgagtacctaattcttctatttatcataaagggtatcagatgaaattgcaagagaatttaagcagatgttatgataaaaaatgtttcaaaaaatactcagcctgtatttctcagacatgatttccaaaagcttcacacccgcgatgctgttgcctttttcatcaagcgccgggccgaatataccgattccgaagttgtacggcgaaatgcccatgattcctcccgaaacgccgcttttagcgggaatgccgaccttgatcgcgaattccccgctcgcattgtacatgccgcatgtcaccataaacgtcttgcagattctcgccacatcttttttaatgacctgctccccggtttccggatgcttgccgtcaagggcgaatacacagccgattttggctaaatccagactgctcatcttaatcgcgcactgttttgtatacaaatccatgacctcttcaacatcgcctttaaaaatgtcatactgcttcatgtaataacacatggcccgattaatcatggatgaactgaattccgattccgcgacatgtctgcaatatgtaatgtcctgattattcgcaagtcttctgatgaatccgagcaggtaatccaggcggtctttcggcgaatgccctttaatgaaacccgtaacgatgagagctcccgcattaatcatcggatttaaaggcttgcccggattcactgtttcaagcttaatcatggaattaaacgggtcgccggtcggctcctgacccacgcagctgaacaccttttcctttccgtaatccatcagtacgagcgccagagaaagcactttcgaaatgctctgcagcgtaaatgtccggtcggcgtctcctgccgtcagacatgtattttccgcatgataaatcgtgaccgaaaggctgtcttgttcagattcagccagagccggaatatagtctgccactttgccttcttcggttctttttttcgcttcctgaactaatgcgtccagctcttggtaatgccggcataccatgtcgatcatcctcacttcgctgccgttgtatacatctaatttgcgacgcaaagtgacaattcatgcgaaaacttttatactttaagtaaaggggggcttcaccatgagcgttattcaggtaaaaggcaatgttacatatccgattacaattgatccgagtgtctggattttcgatgaccgcaagtttccgtttgaaaaaaatcagcccgttcatccggacggctctgcagaaacccaggagcatacgcttgatccggaacgagtgatcagagaagggcgcatttcgccgccgactttaaaaagcgaaaaacgttatgaaaaagaaagactgatgaacggcagcttcgccatgaagctcggcgctgttttagcaaatgccgagccgaaagaaagcgctgtcttgtgcgcatttatttcaaaatcagaaagaaccgaagtgccgctagaaaaggcgctggacgcaatcgcgcatttcagcgatgcagggaaaccccttcaagacggcggcccggtccatttttacgtggacggagactttgaaaaaccgataacgggcgtcacagaaatcgaagttttataacaaatcggcggcgagctgtgcaaggccggatctctcacctttcacaagcttcacgctgccggagacggtttgttctttaaaccgttctaccacataagcaagtccgttgtttaaactgtctaagtatgggtgatctatttgctccggatcgcccatcaggacaattttgctgccctctcccacccgagtcaaaagcgttttgacctcgtgcctcgtcaaattctgagcctcatcaataataataaactgatccggaatgcttctcccccgaatgtatgtcagcgcctccacctgaatcgatccgattcctgccaaaatcgcttcaagttcacccggctttttcgcattgaataaaaattcaagattatcaaagatcggctgcatccacggcttgagcttttcctctttttcgccaggcaaatatccgatatcctttcccaccgggacgatgggacgcgcgacgatcagttttttataaataccgagatcctccgtctgcagaagccctgccgcgagagcaagcaaggtttttcccgttcccgcttttccgatcagggtgacaagcgggatatcttccctcagcaggagttcaagcgccattgtctgctggacgttcttcggcctgataccccatacgtgctcatcatcgaaaacgagtctttttacggtctcgcctttcttatctgtcatgccgaccgcagacgaagatcctcctaattcatctttcatcagcacaaattgattcggataaacctgatgctgctgaagctccttgactgaaatttgtttgtctttataaaacgaggcaaaccgctctttattcataaatatatctttgtacccgctatatatttcatcatggtcaacgactctgtcgtttaaaaagtcctccgccaaaagcccgatggcatccgcctttaccctgacaagcacatctttgctgaccaggatgacgaggcggccgttttctttcgtttcctcctcaaggcttaaattttttgccaccgccaaaatgcggttatcattcgttttttcgataaaaatttcttggagctggtgaaatgaccggtggttcagttcaattctgagcgttcctccgctttcaagcggaactttctcgtgcagccttcctttctccctgagcccgtctatcagcttagatacgtgcctcgcatttctcccgacctcgtccatataccgcttttttgaatcgacctcttccagcacgacggcggggatgacaacttcgttttcttcaaaggaaaaaatggcgttaggatcctgcaaaagtacattcgtatctaacacataaattttactcaagtctcagcctcctgaaataaggatcaaagcccatcgtgtgcttctctttccgcgaataacggggatgcctgctaaaatatatgatttggtgcataaagatagaaggttaattcaacaataaaataaatgaaagcattcaaggaggaaatctgacgtgcgaattcttttcattatcatacaagccttgtttatcctgaccggctgcactgctgtacaggacggccgcggccgcaatattcagaacgaatcagccgatcagcgcgatgcaaaaccgatccatgtgaaaaatacggctcctgagacagctgaaaatcccggccggacagacatcgctaagcatctcgtcgaggtaaccgaaaaaatccccggcatttcagatgccactgcggttgtactcggaagatactccgttgtcggtatcgatgtggatgacaatttagaaagaagcaaagtggagagcattaaatacacggttgcccaggcgttaaaaaacgatccttacggcgccaatgccgttgtcgtggctgatcctgatacggtttcccgtctgagaggcatgggcagcgacattaaggccggccgccccgtttcaggcattttggacgaacttgccgccatcgtcggccgtgtcatgccggaagtcccgaatgatgtgaccgacaatgaaaaagaatcaccgactcaatcgaatgatgatcagctgaaccaaagagaccagaacaagctgcagaacgaacagaacgatcaatcggatcatcatatgaaaaaccgccggtaaaaagcagcgcccgctccaaaggaagggcgctgctttctttccctttggcaggaggggcatccatgttataatgcttgtcatagtgaaagaggtgaaaatcaatgagagtaaaatgttccgtttgcgacaaaatcgaacaaattgatgatgaaacactgacagccaaacgcctccgcaatcgtccgattcatacgtatatgtgccgggaatgccatgaccgaatcaaagtcaaaacggaggcgcggctgaataccggacacttttcctttcatcccggacaaaaagcgaaaaaagataaaccgaaaaaataaaccgaataaaaaatgacccgccggaaggcaaggtcatttttttattgcggtttagctgactggctttttttggactggtgcagacggattttgtaaacgatcaaaatcaaggcggcgacaacaagcccttctccgaccggcagaaacacaccgaaaaaagtcagcactgtgcagccgagcacgagaaagagataaactgccgcagccttcaacaccggcagccgtttggcaaagccgagtttaaatacaatcaccgaaagcacgacgatcgttccgtataacagccacattcccgtcagcggatgctcatccacttggtaaagagccgcaaagaacgacagccgttcacttacttcattcaaaaggatccccctccccttttccgttcgggttctaccttttcaaattctgcaagtgattaagacattcctgctgtttttttctttttcgccgctttttcacgttcgtttttattcaggattttctttcttaaacggatggattccggcgttacttcacagtattcatcttcgtttaagtactcgagtgattcttcaagcgacataatgcgcgctttcttaatcgtagtcgtttgatccttcgtagcggaacggacgtttgtctgctgtttcattttgctgacattgacgacaaggtcattgtcacggttatgttcgccgacaatcatgccttcatatacttctgttccgggctcaacgaagatgacgccgcggtcttcaataccttgaattccgtaagatgtcgcttttccgttttccatggaaacgagcacaccctgacgccggcctccgacttggcctttttgcatcggctgatagctgtcaaacgtgtggttcaggataccgaaaccgcgtgtcagtgacagaaactcagtagaatagccgatgagtccgcgtgaaggtacggtaaagatcaggcggacctggccgtttccgttattaatcatatcaagcatttcgccttttctcgcacccattgattccataacagaaccggtatgctcttcaggcacgtcaatctgcacgcgctcaacaggctcgcagcttacgccgtcgatttccttaatgataacttcaggtttagacacttgaagctcatagccttcacggcgcatgttttcaattaaaatggacaggtgaagctcaccgcgtcctgaaacaacccatgcgtcaggtgatgcagtcggttcgacacgaagactgacgtctgtttgaagctgcgcgttcagacgctcttcaattttgcgggctgtgacatatttgccttcacggcctgcaaacgggctgttgtttacgacaaatgtcatttgaagcgtaggctcatcaatgcgcagaaccggcagcggctcatggtggtcagccggacaaaccgtttcaccgacgttgatgtcttccatgcccgaaacggcaacgaggtctcccgctctcgcttcttcaatttccacgcgtttcaatccttggaaaccgaagattttcgttacgcggaatgattttaccgttccgtcaagtttcatcaatgaaacctgctgacccactttcatcgtgccgcggaaaacgcgtccgataccgatacggccgacataatcattgtaatcaagcagcgccacttggaattgaagaggctcttcggcgttatctaccggggcagggacatgttcaagaatcgtttcatacagtgattccatattttcgtcctgctttttcggatccagacttgccgttccgttaatcgcagaagcgtagacgacagggaactcaagctgttgttcgtttgcgtcaagctcgatgaacaaatcaagcacttcatcaatgacttcttccgggcgggcgaaatcacggtcgattttgtttacgacgacaaccggatttaagttctgctcaagggcttttttcagtacgaaacgggtttgcggcatgcagccttcatatgcgtcaacgactaacagaacgccgtcaaccattttcataatccgttctacctctccgccgaagtcggcgtgtcccggagtgtccaaaatattaatgcgtgtatctttatagttaatcgcagtatttttcgcaagaattgtaataccgcgttcacgttcaagatcgtttgaatccattgcgcgttcggcaatattttcgttggcacggaatgttccggcttggtgaagcaattggtctaccaaagtcgttttcccatggtcaacgtgggcaataatcgcgatgttgcgaagatcgtttcgaagtttcacattttcatctcctaaaaaaattagataactttcatattataccacacatcctctttaaaagcgttacgtttttctgtaaactgaaagtatgacgttaaaggggatggaaatatgaaaaaattgaattggctcttattattatttgcattcgcagcagtcttcagcatgatgctgatcggcgtatcaatcgctgagaaaagcgcatggggcatcatcggaagcattgttcttgttatcgccatgatgggaagcggtttcaccgtaaagaaaaaaatgcgcgaacagggactgcttgattaaaagcatgaccctttgcaaaattccgtaaacatggaaagacaatatcttatgaagcctgaatcaaagattcaggcttttttatatcctcaaaacaggctccagatgtaaggcttatctcccccgccgcctagtcaggaagccggaaatgacagctcccattctagttacatcagcagattccctcagaatatgcagtctgaaatagtccggcatcgttatgcagaaaataccatacctcctatttcaattccatcattgtctttttatacttgtggctgtaagcaaatacacatgacaaggagagaacgaaatgaaaacatcttttttgaagaaaaccgctgtaactgccgccgcaaccgcctcagccgccttgcttgcattcagtccgcttgattctgccggcgcaaaaacgattcaggcaaatgaaccgcatgccctggaggcttccgcagagaaaacaccggaagacgcggcaaagcttttagacatcatcagccaatcgatttacgaaaaagacggtgtctattattttgacggtaaaaaagcggttgaattgggattagatcaagaacaagcccagatcattcaaaagctgtgggacagttcaaccgaatttttaaccgtactttcccaatgtattgagaaaacggacggcgaatatacatttaataaagaaaaagcggtggagcttggctttacggaaaaagaggcccttatcgttgatcagctgttcaccgctttttcccaaagtcttcatatccttcaatctgcgctgattgaagaagacggtgtgtatacatttgatcaggaacttgctgaaaaagcaggagcaggaaaaaaagaagcaaagctgtgtgccggattctttaattcactgccccaggaattgcttgaaggcatttatacagcctttcatccggctgagtaaacggattaaaacgcccggtcattcagccgggcgtttttttaaatcagcagtttaaggatcaacatgataaagaaaacagcaccgaacaaacaggctgcttttatcagcagcttcccgtaataccgttccttaaaccgcctttcttcttctgcataacaggctggcgccttcatctcagggctgccgaggtcaagcggctccttcatcatatgatataaactcccgcacttaccgcatgattcaagatgacgggaaataaatcgctccgtttctgtttcacaatcgccttcaatatataaagggagtaaatctctcactaaacagcaagtcatatctgtccgtccttccttttttccgccaagtgctgtttcagctgcattctcgccctgtacagggtgctcttcaccttcgaaagactccagtccaaaacatcagcaatctcttcgtaagacagctcttgaaatacctgtcgaaatgctgaataaaatgactgaaaatctctgacatctgaaacaatccttttcgtttattaaggcctcacccgtttagacaaacggctataaaaaaagttttacagatcggaacatttttcccctatcatttttcccgacttcatttgtcatttttttcagaataaatcgcatcattcgactcatgtctgattcaacacgtgcctctcggcttatcccccgatgccggccgccggaagcctttccgggacgattctatcaattcatcagcggagtctagttttatattgcagaatgagagaatgctggtttattataacaatataagttttcattattttcaaaaagggggatttattgtgggtttaggtaagaaattgtctgttgctgtcgccgcttcctttatgagtttaactatcagtcttccgggtgttcaggccgctgagaatcctcagcttaaagaaaacctgacgaactttgtgccgaagcattctttggtgcaatctgaattgccttcagtcagtgacaaagcaatcaagcaatacttgaaacaaaacggcaaagtcttcaaaggcaacccttccgagagactgaagctgattgaccacacgactgatgatctcggctacaagcacttccgttatgtgcctgtcgttaacggtgtgcctgtgaaagactcgcaagtcattattcacgtcgataaatccaacaatgtctatgcgattaacggtgaattaaacaacgatgcttctgccaaaacggcaaacagcaaaaaattatctgcaaatcaggcgctggatcatgcttttaaagcaatcggcaaatcacctgaagccgtctctaacggcaacgttgcaaacaaaaacaaagccgagctgaaagcagcggccacaaaagacggtaaataccgcctcgcctatgatgtaaccatccgctacatcgaaccggaaccagctaactgggaagtaaccgttgatgcggagacagggaaagtcctgaaaaagcaaaacaaagtggagcatgccgctgcaaccggaacaggtacgactcttaaaggaaaaacggtctcattaaatatttcttctgaaagcggcaaatatgtaatgcgcgatctttctaaacctaccggaacgcaaattattacgtacgatctgcaaaaccgacagtataacctgccgggcacgctcgtatcaagcactaccaaccagttcacaacttcttctcagcgcgctgccgttgatgcgcattacaatctcggcaaagtgtacgattatttctatcagacgtttaaacgcaacagctacgacaataaaggcggcaaaatcgtatcttctgttcattacggcagcaaatacaataacgcggcctggatcggcgaccaaatgatttacggtgacggtgacggctcattcttctcgcctctttccggttcaatggacgtaacggcccatgaaatgacacacggtgttacacaggaaacagccaacctgaactatgaaaatcagccgggcgctttaaacgaatccttctctgatgtattcggatacttcaacgatactgaggactgggatatcggtgaagatattacggtcagccagccggctctccgcagtttatccactccgacaaaatacggacagcccgaccattacaaaaattatcaaaaccttccgaacactgatgccggcgactacggcggcgtgcatacaaacagcggaattccgaacaaagccgcttacaacacgattacaaaaatcggcgtgaaaaaagcggagcagatttactatcgcgcactaacggtatatctcactccgtcatcaaactttaaagatgcaaaagcagctttgattcaatcagcgcgggacctttacggctctcaagacgctgcaagcgtagaagcggcctggaatgcggtcggcttgtaaacaagaaaagagaccggagaaatccggtctcttttttatatctgaaacatttcacaatggcttcaccatgatcatatatgtcttttcccgatcgtctttttcaagcttaagctgttcaaagccgcattggcttaaaaacaaaacccattcctgcctgtccaggggaacggctgaaaacatcgctttatgctcccctctcagccggcccgcaatcttttcaatgaccgcgcgtccgattcctttctcttttgcctccggagcgacggccacggttccgagccacggttttccgtttgaaggcgcccattccaaatgaaaactgacggcggcaggagcgccgtcaatctcccatacgagccacgttccattgtacatggagtatgcaagcataaactccgccgcattttttgttccgaactcttcgtttttccacaccgggtgtgcagccgccagctgctccagaaacccgagatcttcttcttcaaaatctctacctgtcagcatgtaaatagtcgtcaaagataattttatgtattgccggattgcccgcaagcacgctgtggttgtctaaaaacgtaaacggttcgccgtctgtggtcgtgtaaatgcccccgacttcgttcagcagcacgcagccggcagcgtaatcccacggcgcgagcctcatcgtaatgtatgcgtcaatgcggccggccgcaacactggccagctcaagtgccgccgaaccgtaggaacgcgttcctctgacccgttttacgagcggcgccaaaatactcgggtcaatccttctgttttccgtcacccatgtggcattgattgcaataatggcttcttcaatggaagcttcttttaaaggagcaagcggcgtgtcgttcagataagccccttttccgctgaatgcgtgatacagttcgtcctgcatcacatcataaattaagccgattttgccttttccgtcttcaaagatgccgatggagatcgcgaaatgccgcttttgatggacaaaattcatcgttccgtcaatcggatcaatgatccagacgattccgtcaagggagcggagcttatctccctgcccttcttctccgagaatccggtgtccgggaaaagttccctgtatacggtcaatgaaaaagcgttccgtctctttatcaatatttgtgactaaatcattcggatttgattttgtttcaatcgtcaagctttcctgcatggattgtctgattctcgttccggcttcttttacccattgttttgcgatatcatcaatttccgtccaatttgtcataccgtgtacctcttttctatgtatagcttattctatagcatactgataaaggcgatgaaaaagcaaggaaaatgaaaaaaatgccttctcacgtaaaaacgaaccatttcctgcggttcgtttttactattctttatccgttaagccgaatccattcttttctgagacgttccagttttcttttgctgagatcgatttgatcttcattctctttttgcatggcctcatacagggttgccaattcataatcaacctctagtctccagacagctacacggttatttttttcctccctgaatccttccttcaccacttgcctcattgtctttcgccccttccagagatcatttgttaaaaaagcatcccatttttccaatttattaatgatacttcttatatcgtatggaaacttatattcggctgtaacaacattcttaaaattgtgtgtttacctattcgttttttaccaccaatcctctcggctcaaacgttctcaatgtttttgcggccggcggcggctgtggtaaaatatgaatacttacgataaggaggaaaaagatgactcagatgcgttttacaaaagaagacttcgatacatttacaatagaaggtttagatccgcgcatggaggtgttaaaagaacaagtccgcccgaagctgaccttgttaggagagcatttcgcaccgacattgtcagcattgacaggcgatgaaatgtttccgcatgtcgccaagcacgcgagaagatctgtcaacccgccggctgacagctgggttgcctttgccaacagcaaacgcgggtataagaaactccctcactttcagatcggtttatgggacacccatatgtttgtatggtttgccatcatttatgaatctccgataaaagaggaatacggcagattgctggaagcgaagcaggaggacatcacaaaacagattcccggtcattttgtatggtcgccggatcatacgaagccaggggcgtacaagcagtccgacatggatcaggagcagctgaaaacattatttgaacgcctgcagacagtgaaaaaagcagagcttttgtgcggcattcagctgcaaaaagaagacgtgatcaacatgaacaacaatgaattcctgcaaaccattgaagatgcttttaggaagctttcctttttatacacactgactcagaaagtctcataacataaaaagcgggccgattgccggctcgctttgtctacattttgataatcgcttgatctgattgtttcgcctgtttcacagtccgataaggggaataggtgctgtcagcttcaaattggctgcagattttcttttcctccgctttcccgggaacgatttctttaaagcggcggtacgcattcagaagtctgtctcggtcagctcctttttcataggcgttttccacctgctgaaaaaaagcaatgacatccacggcctcctctgtcgtccagtcctcattcatcggatattgatattccaaatgtcttcactcctttataatcatgctcaaaataagcatcttccatagatcataaattgttctttactttctttcaagttcataatataattcatttgttttacgtttaaaaaacgggtaataaaactgaatgtaatacaaactaatccgtaggtattatgataaaggtgggaaaacaattgccgcaacatgaaacacccctgtacagcggactgaaaaagcacgcggacagacagcctgtccaattccacattccgggccataaaaaaggcgcgggaatggatccggaattcagacaatttatcggagaaaacgcgttaagcatagatttaattaatatcgagcccctggatgatttacatgcgccaaagggcatcattaaagaagcccaggatctggccgctcgagcattcggcgcagaccataccttcttttccgtacaagggacgagcggcgccattatgacgatggtcatggccgtatgcggacccggagataaaatcatcatccctagaaacgttcataaatccattatgtcggccattgtattttccggagcggtgccgatttttattcacccggaaattgacgatgagctcggaatttctcacggcattacgcttgagtccgccgagcgggctttgacggagcaccctgacgcaaaaggcctgcttgtcataaatccgacgtacttcggtgtggcagctgacttgagcagcattgtaaagctcgcgcattctttcgatgtgcctgtgcttgtcgatgaagcgcacggcgtgcatattcattttcatgataagcttcctctgtccgccatgcaggcgggcgctgatatggcagccacaagcgtgcacaaattgggaggctccctgacgcagagctccattttaaatgtgagagaaggtcttgtttccaaagaaagagtacagtcgattttaagcatgctgacgacaacgtcaacatcctatctgcttctggcttcactggatgtcgcaagaaaacgcctcgctacagaaggccgcgaccttcttgaagatacgattctgctggcggatcagacacggaaacgcctcaatcaaattgaaggcatccgctgtgtcggcgaagaaatcacagggtctaaagctgccttcagttatgatccgactaaattaatcatttcggtcaaaaacctcggcctgacgggtcatgacgttgaaaaatggctccgcgaatcatataatatcgaagtcgagctgtccgatttgtataatattttatgtattttcacccccggcgacagagcgggagatgccgaccgtcttgtaagcgcgcttacagacatttcaaaacaggcttccgccaatgactatgctcatcagcaaaccgaagttctgcttcctgaaattcctctgttagcgatgacgccaagagacgcgttttacgcaaatacggaagtcattccgttaaaagaatccgcgggacggatcatcgcagagtttgtcatggtgtacccgccgggaattccgatctttattccgggtgagatcattactgaagaaaatatcagctacatttttaaaaacttggacgccggccttcctgtgcagggtcccgaagatgcaacgcttgaaatgatcagagtcatcaaagagcaaaaagccatccaataaacataaagaagcccgaaacgaaatcgtttcgggcctttttacgctttttactcttcttcaagatgacactggcattgtccgcagcatgttccgtataacgtcgtgaccttctcatcctcaaagtaatgaatcgcttcgttacagtcttggcaaacaattgtacccatctgtcattccccatttctcagaatttgaaaacgcttaattttcacttgttgttattatattattatgtcacatttaatatgtcaaccgataaattgtataacacatttattttttacggtctttttatagctcgagggtcaatcacagtatatcctttatgacgcaatccttttacaatgtccggcatggcttccgccgtccatttccggtcatgcatcaatatgttggccccgtcccgcagataaggactgttcagtgtgatatcggtaagcgcttttttggattgatatttctgatcccaatcatacccgaaggtccagttcattttcaccataccttctttttttataagtctgtcactgtagtccgtattgcttccgaaaggcgccctgaaaaatgcgggtttctctcctattaccttttcaaccgctttattgacgccaatgatttcttcccgttgtttttgttcggaaagatcttttaagttttgatgagtcattgtatgattaccgatcataaaacctaactcatgaatatgcttaagcgctttcttattttcatcttttttcaaaaaatgtccgtttacaaaaaagatcgctgacgcattgagatcatgcagtttgtccgcaatctcagcggcatgctgatcaggcgcgtcatcgatcgttaccaatgcgatcggttttttctctttctgttcatccattttttccacagcaaagcttttcggattgatatagtaacggggctccgccttctgttttttctgtttttcctcttttgtatggtggttttcccgtttggcatgattggccgcggcttgagaatggggtttgtttgtttgcatcttttcatttgattggcagccggcgagtaagcacatacatatgacggctgcagcggctttatacatgacaatccctcctgatatggttttgctcccagtataacgaaaaaacagcgctctcacgaaaaacaatgtgccttttttacacatcggctgcgcaagttgtcacacgtattatttcttcattaaaaacggtttcaattatataacaattcagtaacaagccttaggtttttcacctctcgtgatacacttgatatagtccttataaatggatgaacccatatattatataaaacagaggagtaagatagatgcgctaccgtacggtgattcccttttttttgatgctgttcgttctgtcaagctgttcggtttctactgtcagtccattcacaaaaaaccggatcgacagcattcatcacactcaaatcttgtttttttccgatgaaaatcatatagataaagaagtgccttattacgatgcgattcttgatttagaaaagaaatatccccatcatgtcgatcaaatgaaggtttatgacaacagaaagggatgggaagaggaaatcaacacgttccctgcgctgatggtgatcaatcatcggcatgtggtcatgaagattgagggatccgtaaagaaaaaagaggatatcatcaaacctatgcagcatgtgcttgcacaatagaaacagcccccgcttttacaaacgggggctgtttctttgttacattattatttcacgatatggatcgggcttccgattgctacttcggcagcttccatagtgatttcgcccaatgtcgggtgagcgtgaattgtcattgcgatatcttcagcagtcattccgccttcgatcgccaggctcaattcagaaatcatgtcagaagcgcttgcgccggcaatttgcgcaccgattacaagaccgtcttctttacgagtgatcagcttcatgaagccgtcagtttcgttaagagacagcgcacgtccgtttgctgcaaacgggaacttagctgcaacgacttcaatgccttcttctttcgcctgtgcttcagtgtaaccgacagaagccagttcaggctcagagaatacaaccgccggaataccgaggtaatcgatttcagccggctctcctgaaatagcttcggcagcgattttaccttcgtaagacgctttgtgagccaacggaggtccgtcaatgatgtcaccgattgcgtaaatgttcggtacgtttgtgcggcactgcttgtctgttttaatgacaccgcggtcagtcatttcgataccgacttgctcaaggccgagctcatcagtgttcggacggcgtccgacagtgattaatacgtaatcagcatcaaccgttttttcttcgccttttacttcgaatgtaactgttacgccgtcaggtctttcctcaacgcctttagccatggcgcttgtatggatttcaacgttgccttttttcttcagtctgcgggtaacgagagaactcatttgtttttcgaagccaggaagaatttcatctccgccttctaaaataaccaattcagttccgaagttcgcatacgctgttccaagctcagtaccgatatatccgccgccgataacaacgagctttttcggaatttctttaagcgcaagtgcgcctgtagagttcagaacgcgttcgctatatttgaagtttggcaattcgatagggcgagaaccggtagcaatgattgcgtttttaaatgtgtatgtttgcgcagagttctcatccattacacggacagagttgctgtctacgaaataagcttccccttttataacatccactttatttccttttaaaagacctgcaacaccgccggtaagcttatttacaacagaagctttccattcttggacttttgtaaagtcaaccgttacgttctcagcagtgattcccatgtcatctgaatgttttgcattctcgtaacgatggcctgcattaatgagcgcttttgaaggaatacagccgacgttcagacaaacgcctccaagagttgctttttcaacgactgttactttttgtccaagctgagcagcgcggatggcagctacatagccgccgggtcccgcaccaatcacaagagtatctgtttcaatagggaaatctcctactaccataacattacgcctccattaaaataagttgtggatcgttcagtaaacgcttgatgtggtttaacgcattttgtgcagttgctccgtcaatcatacggtggtcaaagctgagagaaagagctaagacaggagcagctacaatttcaccgtcacggacgatcgctttttcagcaatacggccgataccgagaatcgcaacctctggatggttgataaccggtgtgaaccattggcctccggcagaaccgatatttgtgatcgtgcaagaagcgcctttcatttccgcaggtgcaagcttgccttcacgcgcttttgtagcaaggctgttgatttcatcagagatttcgaaaacggctttacggtcggcatttttcactaccggcacaagcaggcctttttcggtatccgctgcaattccgatgttgaagtaatgtttttggatcacttcatctgttttatcatcaatagatgtgtttaaaacagggaattttttcaaagcggatgttaatgctttgacgacgtaaggcagataagtcagcttgatgccttgatcagcagcaacttgtttgaactgtttgcggtgagcaacaagatttgttacgtcaacttcatccataagagttacgtgcggtgcagtatgcttagagttcaccattgctttcgcgatcgctttacggataccgctcattttttcgcgtgtttcagggaattcgccttcaggagcctgagccgctgcaggtttagctgtttcctgaggtgcagctgtttcttgcggtgccgcttcttgagccgctcctccatttgcaaagctgtcgatatcttcttttacaacacgtccgttattgcctgaacctgttactttacggatatccacgcctttttcacgggcatatttgcgtacggaaggcatggcgatcacgcgtttgttcggatcagcttccgcttggtcctgctgtcctgctccggtttcttttgcaggctctttaggagtctcttctttagagatatcctgccctgcttcagcagacgactgaacttgagcctcagttttcgcctctcctgaatcatggcttcctttaaattgaagatcttcgtaaccaggtgcgtcaaacgtaataatcgtttgtccaacagttgcaactgttccctcttcaacttttaattctaatacttttcctttaacaggtgaaggaatttctaccactgctttatcattttgcacttcagccagaacatcgtcttcttctacctcgtcgttcggcttaacaaaccattttacgatttcgccttcgtggataccttccccgatatccggaagtttaaattcaaatgccacagttttcgacctcctagttgattaagcaaattttagttatgcattcgcaagcattgaacctagtaaacagactccttcatataagagaaaaggactctctttaccgtcttttatgatgcctgattaaaattcaagaacttttttcgcagtttcaagaacgtctttatggtttggaagccatacgctctcagcaagcgagaaaggaaatactgtatcaggcgccgcaacacgcagaaccggagcttccaggctcagaatcgcgcggtcattgatttcagctacaacgttggcagcgatgccggcttgtttttgagcttcttgcacgacaattgcgcggcctgttttttcaacagaagcaataatcgtatcaatatcaagcggacttacagtgcgaaggtcgataacttcagcagaaacgccttctttttcaagctcttcagcagccttaagcgactcatgaaccatcgcgccgtatgtgatgatagaaaggtcagtaccttcgcgtttcacatcagctttgccaagctcaattgtgtattcctcctcaggaacttcctgacggaaagaacggtaaagtttcatatgctctaagaaaacaaccggatcattgtctctgatagaggcaatcaacagtccttttgcatcgtaaggagtggatgggataacaactttaatacccggctgctgagcgataaggccttccaaactgtcagcgtgaagttcaggtgtatgaacccctccgccgaatggagaacggattgtcaccggagaagtccagcgtccgccggaacggtagcggagacgagccatttgtcctgagattgaatccattacttcatatacgaatccgaagaattggatttccataacaggacggtaatcttgcaggcctaaaccgagagcgagaccgccgataccggattcagcaagcggcgtgtcaaatacgcggtcctcaccgaattctttttgaaggccttcagttgcacggaatacgcctccggcaacgcctacatcttccccgaaaagcagaacgttttcattgtttttcagttctgtgcgtaacgcatcagtgatcgcttgaatcattgtcatttgcgccatggcttacttcgactccttcgctttgtaaatttcaagttgttctttcaagttgaacgtcggctcttcaaacatattctcaatcagctctgttactttcggttttgattcgccgtcagcctttttgatagcttgtttgatttcttctttggcctgttcaatcactttgttctcttcttcttcagaccatagtcctttgttttccaagaacttgcggaaacgtacgagcgggtctttttgctcccattcattttctatttctttcgtacgatatttagtcggatcgtcaccggacattgtatgaggtccgtaacggaatgtaagagtttcaatcagagtcggaccttcaccgttaattgcgcgctggcgtgcttctgcggttgcagcataaacggctagtgcatccattccgtctacttgaacacctgtaataccgacggcaactgctttttgggcaattgtctgtgcggatgattgcttttctacaggagttgaaatcgcatagcggttattctgaacaacgaagatcgctggcgctttaaatgctccggcaaagttcattccttcatagaagtcaccttgagaagctccgccgtcaccagtgtaagtaatagctaccgcttttttaccgcgctttttaagacctaaagctacacctgcggtttggataatttgagcaccaataataatttgaggtgataaagcatttactccctcaggcatctgattacctttaaaatggcctcttgagaacaggaatgcctggtgtaaaggaagaccgtgccaaatcagctgaggaacgtcacgataacccggaaggataaagtcgtcctgttcaagggcgaagtgtgatgcaatttgtgaagcttcctggcccgctgtcggtgcatagaaacctaaacgtccttgacgggaaagagaaattgaacgctggtctaaaatgcggatatacaccattcttctcattaattcctttaactgatcatctgaaagatcaggcattgcgtctttatttacgacttctccttcagcatttaaaatttggaacgtttcaaactgcttatgaatagcatcaaattgttttttgctatcaacaattgaagtttttgtctttgcagccattttttaaaccacctcttcttttgatttaacagggttaggataccgtttagccatccgtattaaaaacagtcttatcatgctctgcaattctaaaattaatcattcagaaattcacatagcgcttaagcaaagataatgacgtttaaactgtactaataaaaaaagattttttattagtacaatatgatcaacaaccatagtttacagtaattaaacaaagccgtcaattatttataacctcattttgaaaccgcttataaaacataagatcatattgcgccaaactgtactataaaagactttaaactgtattataaaaatgctctactgtactataattaaaaaaaattacaaagagtaaattaagttatttaacttcagggcgggctttgaaaagatgccgcgggataaaaacgggcagttagcaatcgtcccgcctgccgaacagacgggacgatgcttttgtctaattattcaatacccgcccacacgatattcagcggcgtcagcacggcatgaggatgaaactcggaaatcggagtgaaaaatacatacgtaaaatcttcggctggatcagaaaacatgccgcaccaacccattccaagatgtgagaaggtgccttctgtcatgaaataatggtcaccggccggccacaaattaatgcctaaaccaaagccgccttcctctctgggcgctccgaagaagtaaaaaggaagaccgggctttatttgatttctcagcatcgcttcgactgtttttcttccaagcagcttcttatctttcaatctgcctttatttctaaacatttcagctaacttccaaatatctcgcaatgaagagtacagaccgcttgtcgctttattcggaaaatacgggtgatgacttttttccagctgtacgcactcgtgctcattgatcacacaaacttcttcttttaaagcatcaggcacataaaaatacgttctttctaatccgagcgcttcaataatatgctttgttacatactgttcgtaggatacgcctgttacttttgaaataatgatgccaagtataacaaagccggttctggaatagttccatgcttcatccactccgtactccaaaggcgtactgaccagatagtttatccattcttcctcattcgttaagtcaatgccttcagccttttgaatatccagctcaaaacttaatcccgccgtatgagtcaaaaggtgcaaaattttaatttctccgaaacccggtttatcaaacgctggcaaaatgagcttgaccggcattttcagatcgagcaaacctttttcgacgagctgcatgacggctacagcggtaaacacttttgtcaaagaaccgatttctctgattgtatcaagctgaaatgtttgcttttctttttgtccgccggtaaattcccctaacgactcagctgcaaaaacctcacctcctcttgacatcatataactcgcacattgcagatctccattgtctatcatcgtctgataatggccgttaagagcgttaatttgtttcatatcaaatgccggattgcttattgtttgtttcattgttttctccccctgtactgtatgtatcgttttcatcccttacttactgatttcttgatgaattctgacaccgttttattaaattcttccggatgtgtaatgttcggaagatgccccgctcccttaattttctttaattctgcattgctcagcagtttctgcagcctttttgtttctttctgatcaactacgctttctttctcacccgtaaggataagcgttcttgtatgaatgtcttttaaaaagccgattgtagaatagccttcttgttgatgtatcttcataaaacgttcaatagaagcatttaagaattgattactgtataaactttcatattcatgcgactttcctatagctataaaatcatttttcagtttttcctcgacactgctttcagggtcttcttcgtattcggtgtaacttccggaaagaatgagcgtttttactttttcagggtattcataggctatcctctgccctatcatgcctccccaagaagctgccgcaatgtggatcggccaagcaacccctatctcgttcagcacttcgataaaagtctgagccagcccgctcagtgtaaaatcggcgctcccctcactcagcccgtaacccggtgtgtgtatgacaattacattaaattgatctgcccactccttcatttgttctttccacatgtaagcagtggtagcaaaaccgcaaatcagtaaaattgtttcacccttaccgctcatcaatatttccatatgccgggcattttctgtgtttgccagaaaatgaacggtttccgtttcttctgtctggtaaaaagcgatgagtttttttgcggcatcgctttgattgtgctgaagggctcctttcttcagtctgctccaataatgcaaataatcgtcgagatgacgattggaagccgtgccgagtattcggaaaggactttcagcttcttccgtaacgactgatgaagcatcaaaatcggctgcaatcgctgaatctcttaccagaggcggtgctgaacgggcggataacggcttgaaatcgttttgtattttttctttttctccgtataacacgatcagctggtggccttggccgagaagcgagtgttcaaaagctttgattccggcagtattttctaatgggtgaagtccgtactccgttttcataatgtcttgaatgccgggatcaactgacatgcctccgtctttccagaaaggccaatttacagcgatggtttttcctgatcttccccccgcctttctcatacattccctccactcggcaaaatgctccagaaaacgattggcgtaggcgtaatcggcttgacccagacttccgatttctgaggagatggaagaaaacaaaacaaaaaagtctaaaggcatatttctgagcgcttcatccaaatgaatcacaccattgacctttgattgcagcaccgcttgagcttcctcgtctgttttattcataatgagagagtcttttaacacgcctgcactgtaaatgaccccgttgatttcggaataatcagcatgaattttttccgctaaattgatgacctgctgcttatctgacatgtcagcctggatataagaaatgcttgccccgtcatatcggatgctgtctaatttttcttccatgtctgctgtcattttcgatcgcccggcaatgataacgctggctccgtgatttgcataaagaaacgctgaaataatccagccgatgccgcttaatcctccgatgatgagatacaccccgttttttgcaaactttgcggccttttgccctggttgcagcgaagcgtctttatatgctgtcacccgccttttttgatcgccgtcatatttcacagactgatgatgtccggcacttaattcattgagaagcaaaggtgctttttcaatggtttgtcttgaagaaatctcaaccgttttacactttatattcggctgctccgcattcagcgttttaaaaaagcctccaatcgcggcgtaaaccggatttgtatattgacccttgtcatgtacgtacagaatgttgatgttttcttttactttttgatggatcaaagctttactcaaataaagaattgaataaaagctgtgagtcagatctaacgctgcctcagtataagctttttttgacaggtaatgaatgattgacgccggaaacgctccggactttttcatatcttctaacagtctggtgtaatgagcagactgctccggattaaatttataatgcttttcatttactatttcatattcagcggcggcttccgcataaataacattttcactgccgatgtactttcggatttcatcactcaatgaactgccgaaatcgaaaatcagtgtattttccttaggtacttctccggactttaatggcgattctatccattctttttgtaaatacaaggaatcaagcaccagcttttcagacggctctttcgtttgcgttttttctttaaaagctgcggccggcgtattacgcacatcatatttttcttctaaataagccgctaaatcatgaatattgttataatcaaaaagcaatgtcggatacaattgtgtatccaatctttcctcgagcattttcgatatatgcagcagctgttttgagtcaagacccagttcgtaaaaagattggtgtttgtccgctttatttgacggtgtgtttgtagcctctccaataatggatgacagctcatctgttaatgttttatgactgtcttggtgctgaactgtatcagtgatagagtctgtaatgtcggctccgtatttctcctgcagatattccgtcaattcaccgattgtggagtaatcaaataataaagtcgggtacaactttgaacctaacatcagttctaattttttggataagtctaataattgtttagaatccaagcccatctcgtaaaaggaaatatcattcttcactgtttcagcaggtttttcaatcatgccggctatctcttggatcaaattatttctgatcatttctttattgttcgttgcgctgccgacctctttagctttttgggaatgctccagcctttgtattgaattttcatttctgactcttttcacaccgaatcgctcataataaaaagcaagctctccatcaggcctgtatacttctatgtccgcatataaaatgtctttagaaggcggctgcgttatactggttttattaatatacacaaaacaagacccagttgttttatgcagtgccctgaatgtctcaatatatatagggataaacgcatttgttccttcatccggcaagtctgatgtaaggattcccaacaagctgagagacccatccaaaaatgcgggatgcatgtaaaagtcatctgtatattcttttgaaagtccgcttaaactgacctctcccagaatataattttcaccttcatataccgtaccttccaatttcataaaatctttatgaatcaggccgcccctgcgcaaattacgataggcggcttcagcatccgaaatccggacggcccctttctttaattcttcgattgaaattgtcttttcgtttatcgcattttttcttatgatttccgcctgcaagttgactgacgcttcaccttccgccttttcagcgacccatttcctgcttgttgtttcaataagccagccgttttcttgttccgtaaactggaaggtgacttttttatcaaaatggactgacgtcgcaacaggttcacggaataaaacatgtttgatttcaaaacttcggggtgatatccctttctcagctaaaaatcgtgttattaaatccagatacgttacgccgggtatcgtacgcacttgatgaaggacatggtctgaaacaatataatcgtcatgtttgactaatacgctgaacctcatgcaactcgacaacctttcttcttttacaaagtaaagaaacagagcaggtgctactctgtttcatcaataatttcaagaagccgttttttattctgtttgatttgttttttccgatttgaatccggccagtactcttttctgacaaactcggcaggcggcagcggagttctgacggaatgatatgaatcatccaggccgcttaccaaaaggtgggcgtttgttccgccaaaaccgaaagcgctgatgcccgccctccgttttccatccttccagcttctcagctctgtattcggataaaaaggcgacttttcaaattcaaagcggggatttggcgtttcacaattcaatgtaggcggaatttccttatgccatattgataaaatcactttaatgaaacttgccgctccggcagcgcttaataagtgtccgatattggtttttacacttcctactccgcaaaattgcgttttgtttgtgtctcttcggaatacttttgtcagagcctgaagctcaatcggatctccaatcatcgtgcctgtgccgtgagtttcgacgtagctgactgatccgggagtgatatcggctttttcaaatgcatcttgaataacctgctcttgaagcttaggattcggggtcgtaattcccattgtcgcaccgtcgttattaatagctgatgcttcaatgataccgtatatccgatctccgtcagctttcgctttctccagcggttttaacagaacagcgccaaaaccctctccgggtacaaaaccgtttgccctttcatcaaaagtaaaacactgaccgtccggcgaaagagctcctccttctgttaacatcaggtaaggaatttcatccaaaagcagatccgcccctcctgccagcgccatctctgaatcaccgttttttatgctttggcaggctaaatgaatgctgactaatgaagaagaacaagcggtatcagaaaccatgcttggaccgtgaaaattaaagaaatgcgacacatgtgaagcaataaagttttgactaagcccgacgatgtggctgctgctttctttcggcagtttgtgaccgtagccgcccattctggaaccgacaaatacgccgactttttttcccgataattccgtttcttcataaccggcatcccgtacagtctgtacactcgtttctaagaaatgtcttatcagcgggtccgtttggatggctttctcctcttccatgcggaaatactccggatcgaagctgccgattccattgataaatcctccccatttgctgatgctttttcccttttgctgcaccggagagtaattttcttctatattccaccgggaatcaggtacttctttaatatgattcttcccttttctcagattgtcccaaaattcctctttatcagccgctccagggaacttacatccgattccgataacagctatctttgcagaggaagccgtctgcggttctgtatttcggctcgtcacagactgcatatcttgctgattgctgctttgagaatcagtctgttcgacttgttttttcaacggcggcgccgtcttaccgatatattccgcaagaccatgaatcgtgttgtgttcaagaagcacagtagggtcaatttttttctgaatcattgcttctattcgatgtataatgctcacaagtagtatagaatccacaccgtattcctgaaaatccgtatttgggttaagcttttcaaggggaatgctcaattcctcggcaaatacggcagaaagttcactgacaagcccttctgaatgatcaaaagtgtcgggagtctcctgtcttcggactggaaccgaagctccgccggttttattgatgttcaggagactgtctgcatgaaacactgttccttttttcacgataggaatgatattggccgattttctctccagtgcatgatacaaaatcgccagtccttcccgtgtggatagagagtccagtcccaattcatcatataaaggactcgtcacagtacccattccgacttctttccagctcggccaattgatggacgtgaaatacgttctccccttttgaaaatgataagccgcgaaatagtccatatatgcgtttgcagacgcgtaatcagtcattcctttcgacagtttgggtgactgtgctgcaattgatgaaaatagaataaagaaatccagcggcctattattaaaaatccgctccaaattctgaagtccagtgactttcggcccgtacaccgtcttaaattcactcattcttttatgaataaaggccggatttccgccgctgtgcagtccggcacagtgtatgacaccgcttatatctttaaattcaaggcttacttggtgaaagaatgaacgcagcttctcttcatttgtgagagaaccgctgtaatacatatagttgacacctttctcttcaaaactttgaaacagttttatattgctgactgtcttttcgtcctgtctgccctctttcagcaaatgatcccattcacttcgcaaaggtaatggacgcgtacccgtcagcacgagttttttcactccccgtttcaccaaatcttcagctattgctctgccaatgccccctgtcccgccggtaatcacgacggctttatccgcaggaaatgaaacaggcccgccggtatggattctttcttcttcaaaatacggaacatatctgacgccgctgcggtagcatacttcattctctccggtacattgcctttcattcttaaagatttgtttcagctcatgcgtttctttcatgctgtctatatctattgttttcacatgaacaaagccgtattccgcagaaagggctttcagaaaagccgctgattctgcccccgtcagctttggtttttccgctttaaatacctgcaagccattggtgatttgtaaaatggataatggtgtttcctttttactccgcttaattatttcttgtataaataagaatttacaatatgggatgccgttctgattgtcactctggtttccgatatctgagaaatcaaatatattttcgaccagccgctcaccgcccgagaagatctcacggataacgtcgtatgcgtggttttcatctaataaagaacactcaaacatttgatcagagtgttttataaatgaagagtgatgtttgatgacaatcagattctcctgatctatatccgaacaaatggagcgggcaattgattctgtgtcttgatttacaaatgctactgtcagtccgtactcttttgtttcggatggatttacaaacggattctccctccattttttttgcaagtgatgttgaaaagaatgctgagggatctctgtcttctcagtcctggacggaacccaataacgttcttttgcaaacggataagtcggaattgagatccgtttacccggctgctgtaaatgttgatgaacggatttccagtcgatatccgccccccaaacccataattgagccagcttttccgcttcaccgttctcaataatggtctttacaaacaattcacctgctctgccttccgttaacgccttcattttttcagcaaatgcatctgctgattgctgatgaacatatacgcctggaacttgcttgtcaccgcggcaaaactcaaataatttatctttcatttctttaagagaggtaccgataatcgccgctctggcctccatcgcttctctgcccgattgtgtagtgtatgccagatcccgtaaaacgacgctttccgattggctgccttccatcacttcattcgggaacaggtttcttatcgctccggcatattccttcaataagtattcagtaaccgcttgaatggaggggcaatcagttaattcatacatcgtgagttcaatatgaaacatttcgttaataaaatccgccatccggcttaattccaaaggtcctacgccaaattcactcaggtgatcagcaatattaatttcttccggatggatatgaagcaattccgaaacaaacggtttgagtacttcatacaccttttctttcatatcaggctgcttatcctttacttcaggacttagtgaacgctggataaaatctctcatgttttcggcatactcaagaagacgttcattgtctttggcagataacaggacaatatgcggttcgttctcaacatgttctgttgagacgtttgtttcttcatattcttctataatgatatgaacattcgttcctcccgctccgaatgagctgatccccgctcttctcggaacagttactgtttttccgttttcctgcagtttcggtttcttccaatcttgcaatgaccgctgtacataaaagggagaggctttaaaatcaatatttggattcaacgtctccgcatgtatggaaggaaacagttttttcagtttcatttgcaaaagaacctttgtcaaaccggcaattcccgctgcggcctcaagatggccgatatttgatttgacagaaccgatggaacaatattgagtgtgctccgtaaattcccgaaacgcttttgttaacccggtgatctcaatcgggtctccaagagaagttcccgttccgtgagcttcaatataactaattgtacgaggatcaatacaagctttctgaagcgcgtcctgtatcagttcagactgaccatttggattaggaaccgtaaaaccgtttgttctccctccgtgattgaccgctgtcgctttaatcagcgcataaatatgatctccgtcccttaccgcttccgccgccggctttaaaagtacggatcccactccttctcccggtacataaccgtcaccgccctcgccgaatgtccggcatcggccatcacttgcaaagaagcggctttgatttaataatgtatatttattgggatgaagcgtaagattgaccccgcccgcaacagcaagtgtgctttctcctcttcgtatactttcacaggctaagtgaatggcgttaagagaggatgaacacattgtatcaaccgccatactcggccccttaaagttaaagaaatacgatattctgtttgctattgcagaaaatggagacccgacggccagttcatttcctttaagtgattcttcaacgccgaaaaattgatagcttccatatgtgacgcctgcaaatactccgacctttttgcgggtcagatctgaaggtttataacccgcatcctctatggtattgtacactgtctctaaaaagagacgttcctgaggatcaagaaaagccgcttctttcggtgatatccggaaaaataaaggatcaaaccggtctggatttttcagaaaacctccccacttatagcagcttccctccagcatttctttccgatcatcaggaatttcgcttacgcaatcccgtccattcatcagcacattctggaactccctgatgttttccgcacccgggtatctgccgctgacaccgataatggctatatcagcagaaaggggatcggccgcaatgtgctcttttgaaccttctccttcagagcgtaccggcgcttttgtttccactggttttcttttttgctttttttgatatgagacaagttcagatgtgccggccggtttcagcagtttcatcattcgttcgctgtgatgactcaggaaatattcagctaactgagatattgaatgatattcaaaaaataatgttttcgacaatctgccgatactttgctccagctttttggtcagacgcatgatcattactgaatcaatgccgtatttctccaggtattgtttttcatctatgagtgagaccggtaatttcaattcctctgacattatatttttcagataactgatgatattttgtcttaattcatcgttttgcaaatcggcatctttctgctggtctgaatgtaagctgattgtgccggcacgcttcagcacatcctcaatcttttcttttcggcctttcagggcaatcagctgttcagatgattgacacaagctgttctccagagcctgtattccgtcactgtcatctaacgggtcaagaccgagttcctgtttcatgtaggatattccttcatcgtcaatattcatcccgccggaagtccatagcggccaattgactgacactatcctttcggcagactcttttgcggtcataactgctgcatactgatccaaacaggcattggcgaaagcatagtcacattggccggctgagccgaagactgccgatgtggatgaaaacaagacaagtaattcaactttcatttttttgatttcttccgccagccacagcgtgccataaactttcgaacctgtgacttgatcaatttcttcttttgtctttcttaagataaaagagtcacggagtacgccggcactgtgaaatactccatgtaaggtgccgaactgctcttttgcaaaagcaaacatccgttcagcatcactttgttttgaaacatcagatcggatatattcaactgttgaacctgaacttcttaaatattcgatctttttctcctgctcttcagttaaatcagagcgccctgtcaatatgagattcgctttccatttttccgacagatgttttgccagaatataaccgagaccgcccaggcctcctgtaatcagataattcccatgatgtttcagcggctgggttaaatcgaatgagccggctttattatagcttttcgtaaaacgtctgccgttttcatagcgcacttcaaaatggatatcccgtttttcgtcacactctctctgatatatatccgctattgctggaagagcggctcccgcaccctctgattgcgtgatattgataatctgatagtgaaaattggggtgttcctggtgaacagttttcaccaatccgccgagagcatgatgcagcggcagttgttctttattctctgtttgaaaaatatgcgtcagctttattatctttttccattttagttcaatcagcgcctgtgtaatatacagaagagaaaacaatccgttttccaattgtttctgtatacctttcttactcatgtcagcctgagaatcagaccacaagtgaagaatcttttcgggcagctgaaaatgatcatgaatgtatcggaacagctttagataatcgtcttttttcacgtggttcatacaaatcgtatcatcatgtaaaacagcaaattcttttccgcggataacaaacaagagagtacagtccttaaacaaaccgctcaattcttgtatttgccgttcattttctgcaaaaatcaggagcaatcccgtcaagggtacgctcttcttactgggaatgaacgattcagtccattccggcttgtaatataaaagcggatggttcgatgcccgtgatttttgattctgaatggatgtcacacgggcatagccttcgtcagccgacatttgtcctgtttgaatcagatcaagaatatcgctgagtagttcacgttttccgttcatcattcttcccccattaattgtttcaatacagccttctgatcaatatcattggtttccaattgacgcaggagacgaatgagttcgtcgtccgtctgaacagtgtctttttcatgaccatatctgaatctcacatctctgcactctgccagaatgcttccgtttttatctgtaaacgtcatatgacacgttacatcacggctgttctgccggttctctttttgagtatagacataaaaattttgagcgagagggtgatagacatccgccgctcccattccgatcaattccgggaaggtttctccgctgacaaaaaacgcactggcttgaatcgcggactcaagcgcttcaggagagatcgtaaaattctctctttttgcataaagctcatccggcaatgaatgaagcgacagcattccgtcactgtttttcgctgattcaatgacaaaaggcgcttcagcaggatgttcagtcatttttgatttgacttcagcaatatcaagcgcttcaggaaacataccgctttcaggcttaacaatatgcgcatttcccctggcaagacgtactttattttcattttttgtgtttgcatatatgtcaaaccgcgcaaagtcgcgctcaggcgtcagcgtaatcatcagttcccgtatatcagtcattccgttcatgctttcggtccacaataaatcagtcaatgtttgaaccggttgtccaaatgccgccgctgcattgacgatagccatttcagccaaagatgcataagggaaaaaggacatgtttccttcagacagacttagtgcgaacggatgattacggctgatttttttcgtgaaactgaactgattaaaatcggacgtgttactccccaagaaagggtgacccggcttactcacatccgctgaaacaagtgcttcccctttttccgctatccaataccgctgtttgatcagcggttgtcccggaatagaaatcctgcgggcattccgattcacctcaaaagtctcccaatctatctttcttccatttacccatttggatgctgcttcggcgtaatctgaacaaacgtgagacatttcattgtgaacttctgattcgaatgtattaccggtatagcttaagctgcttttttcacccctggtataagctgaaagctcttcagcaatgacccgcccggaatctgccactatcgccagccgttcttccatatgatcgcgtcccgtctgaagtgtataggcaatatcctgaagacgcagtttatgtttgttatccttcgattcattttctgatagaaaatcagccataacctttgcatattttatcagccgttgtttgtcttgagccgataaaacaaagatcactcggccgctttgatgatcaaaagcttttggcggctcatacgcttccaatataagatgcgcgtttgttcctcctgccccaaaagcgcttaccccggctctcaaaggatgaacagcattgctgttttgcggaatattccattcagccgctttccgctgcacttgaaaaggaacctgatcaaaatctataaacggattaacaatatcggaatgcagagaaggaacaagctgcttattcttcatttggagaagcactttcgttaccgcagcgattcctgccgcagattctaaatgtccgatatttgatttcaccgaaccgatggcgcaaggatggttcaattgataggaatctttcagtccttgaatttcaatcggatcgcctaatgacgtccctgttccatgcgcttcaatataattgacggtattcggatcaatgtcagctttacgaagtgcttctgaaatgacctccgcctgcgcatccggattcggtatggaatacccgctcgtctttcctccatggttaacggcgcttcccttaatcacaccgtatatttgatcttgatcttctattgcttttttcaatggttttaacaatacggccccgactccctcaccgggaacataaccgcttccgtcttttccaaaactccggcatctgccgtcacttgatagaaactgtcccatactgaggaacttatatttattcggatgtattgacaaattcactccgccggctaatgccatatcgctctctccacaatgtatgctttggcatgcgtaatgaatagaggtcagtgatgaagagcacattgtatccagagccaaactcggaccttttaaatgaaaataataagacacccgattggcaattgaagaatagacggacgccggcgagaaagccactccattttcttctccttcaaatagttgatattggccccacattgcaccgacaaatacaccgactttcatcttttccagcatgtttctcgggtaccctgagtcttcaaaacaatgtttggccgtttctaaaaagagcctttcctggggatccataagttctgcttcccttggggaaatatgaaagaaaagcggatcaaattgatcggctccgctgataaaacctccccacttgctgtaagacttccctttcatatctctgtcttcgctgaagaaatcatccatattccagcggtcaggcgggatttctgtaatacaatcttttccgctctttaaattctcccaaaattcaggtaggttttcagccatcggatactttccgcttaatccgataatggcaatgtcctcatgccttgtatcagctgtttcatttatttggatctcacggctttcatcctctatgaaggtatcttgaagtgcagattccaatttttctttgtcaccttcaaacacgatcagctgtgatgcgttcagagagagtgaatcttgaaaagctttgatcccattggttttactaaggggaaccataccgattttttgtttcatccatttttcagtttgtttatccactttcatgccgccgtcttcccatagcggccagctgatggctactgagacgccggagcgttcttttttccgcctcattccttcacgccactcagcgaaaagatcgatgaaccggttggccaatgcgtaatccgtctgtccgatattcccgtacatcgaggtgcttgatgaaaacatcacaaagaagtccaaaggttcggtttgcagcaagctgtccaataagaccgtcccatttattttcggagcgattacttcctgaatttcatcttttgatttttgaatcaataaagcgtcgtgcgtcacaccggcactgtgtatcacaccgttgatttctccgaatttccttttaatggtttttatgattcgctctgcatcgcggctatctgaaaaatcacctcttatatattgaaccgaagaaccgcctgctttcattcggctgattttgttctttttgtcttccgtaagttcagaacggcccgctaaaataatattggctttcgtttgggctgcaatatgttctgcaaatataaggcctaagccgccggcccctcctgtaatcatgtatactccgttttctttaaaggagaaatctgagtttggagccggttctgcttcccgtaaggcacggacccagcgcacatttccttcataataaagatcggtttctcccggatgcgcttccgtagattcgactctgatgatttcagctgtaagttccggcaacgatgacttgtctgatactgatatcccgattgtcttaagggccagtttcgggttctcaagcacaatagactgccctgcgccatggactgaagcgtaaagcggctgatcatttttatgatccgccggataaaggaaaagcgatacaacctttttttccgtcttgctgcgcatcaatgcccggctgaaaaataatagcgggtaagcccctttagaaagctgttcacttattttttccgggccggcaaatgatccttccggccacccgtacaccacggtgtcgggcatttgccccctttttttcagatcagctgcaagcctgtcaaagtgagcttcctccctgtgatctatctcataaacaccgtctccgtgataggagaaacgattccctgataaaacgagaatgatctgtgtattttcgaacccattttcagcattttcccgcataaaatgaaaaagctctctgtcatattgaaacagcaggcatgttcttttctttttattgctgcaatgcgggtcccaagcggcaggcttttgtctccaatacggcgttaaatatgtcagagccgtatgattctctccatgatgaagagggaggtctttgtcaacgaaagtcttttcgccgctctctgcaaaataatttgcaagtttttgaatcgtcggatactcaaacaataaagtagggtacagttccctgcctgttttctcctccaatgcttttacggcttgcataagtgttacggaatcgaggccttgttcataaaaaccttttacaacagagagtgtttcaggggcagtccctttgatgtctgcgatcagctgctgaatgtctccttctgttataagagcggaaagattttcgttcttactttctttcatgtcaggcttttcagccggttgattttgcgttaagaaataactggacattttttgattttctttaatatacgcggcgagttcccggatcgttttctgctcaaacaggagtgtaggatacagctgttcccctgttttgttttcaagttctttgacaatggcaagcaaagaagctgaatccaggccttgttcataaaaaccaatgtctgtccttatgtcacgcagatctatatttgaaaccccggatattaattctttaaggtgtgtctcgatgctttcgcttcgatttatgattgaatcttttctgatcaggctgtcttttggctgagaagccgcttcagtttccaaacgagtctgcttcaggttttcaattaaatcttttgagcgaatatgtttcacagacagccgcgtaaaataagcgatcatctccccgtatgcatcgtacaaaccgtaacttacttggatgacatcccctgaatcatgattttggtcttgcttctctatgtacacataacacctgtcttccaggcgcttcgtcatacggaaagattcaatatgaatgggaatatacgttttcatccggcttgccggagatccttgtgtaaaatattcgggacatgcctgataaaggatcgatatgatggtagacgcatcaagaaaagtgggatgcaattgaaaatagccggtatattgattggcaatttggctgagcgttaactctgcaagtacagaatgatcagacgcataaaccttccccagactcttcataaattcaaaatgctctatatcaaccttttttaaatagtcataacatatctccatatcatcttcacgggcggaggcatgtttaatttcatcaatattgattgaactcatgctttccgggaatttctgcatgagcctgcaggtcatattctcatcccagctttcatccagaatgcggtcatcttttacctttctgctcttcgcctgaatttcccatccctgttccaatccctgaaaacggatgcggatttctctgtcaaaggtatccgatgttgctacaggttccaaatacaaaatattctgacactcgagttcttcaataggcaaacctttgctcagcgccatacggtatatcatatctaaaaatgtgacaccgggtataatccgggtgccatgcacccggtgatccctgacaatatagtccgtatgtttaattgttaatgtgaactgatagttttgattactggccacctgtctcattccttttcttttctttataattctttgaaatcaagtaaaggaatcagcaattctgactcttccttttctggagtttctccattgtcgatccagcattgttccttattgaatataaccggagaaagcgggtgtctttttgtctctccatatcctaatgtgagatggctgtcgctcaatatcatatgtgcgttcgtgcccccgaatccaaaagaactgattccggctctcaaaaccccttttctgggacgccattcttttaaagacgtgttcggaaagaatggcgactgatcaaatttaaaacgcggatttggcgttttacaatgtaatgtcggcgggagcatctgattttttatggataaggcaacctttataatactcgctatccccgctgcgctcattaaatgtccgaaattcgtttttacgctgcctactccgcaaaattgcctttcttccgtaacctcccggaacacttctgtcagcgcttttaattcaatcggatctcctatcatcgtaccggtgccatgcgtctcgacataactgagagtatctgcatcaattccgccttttttcagggctttttttatcactgcgctttgcgctttcggattaggtgttgtcattcccattgtctgtccgtcattattaaccgcggatgagtcaattaccgcgtaaattctgtcaccttcggcaagggcgtcatcaagtcttttcaaaaggactgcgccgcatccctctcccggtacaaatccatctgccttctcatcaaatgtatgacattttccttcaggtgaaagcgcccgagcctcactcagcatgacgtaaggcttttgatccagcaaaatgtcaactccgcccgcaatcgccatatctgactcttttgacatcaggctttgacaagcgagatggacgctgaccaatgaagaagaacaagccgtgtctacaaccagattcggtcctttcagattaaaaaagtgtgagatatgcgcgcctatgaaattttgtcctatacccacgatcgtattttttgaaggggaacctattttggacataaacgtcccggtccgcgaaccgatgaagacgccgacttctttgtttgatacttcttcttttgtatagccgccgtctctcaaagtctggacgctgacctcaaggcattttttgattaacggatcaagctctgatgcctcacttttgttcatattaaaaaacgcgggatcgaaagactcaatatcttgaagaaatccgccccacttactgatactttttcccttttcataggtgtcagagtagtatgaagaaatatcccatcgcgacgccgggacttcgcggacactattttgtcctttcttcaagtttgtccagaacgtttctgtgtccggagcatccggaaactcacagcccattccgataatagcgatttggttcagactggtttgttgtatttgagatccgctgtcccgtacttcggaagcattttgatttatatgttgctcttttttccgaacctcaatgttttctgaatcaatttgaggactgattccctcacttgcaaataattcgtttaaatagacgcccagttgtgaaaaactcggatactccagaaaagctgatggttcaatttttatttgaaatgcatcttccgcttttttgacaagctgaaccagtaagattgaatcaactccgtaatccgcaaaagacgtatcctgatctaaattctcataaggtattttcagctccgcggaaaaaatctccattaacttcctgatcatagcttcattgtctccctgaccagagatctctttttcttcagcatccgggttatttttagcagcttgaattcttgtctgaagcagctgctccagcttgaatttctccggatgtgtctttgccggtataaggcaggggtatccgtttatcgtcatcatttcatccagcatggcaatacctgtttctgttgagtgtgaaagtaaaccaagtgcctgatatgatggactggtcacctcgcccatcccaatgtccttccagctcggccagttaattgattgataatacgttctgccggctgcatgctgatacgccgcaaagtaatccataaaagcgttcgctgcggcatagtcacttgttccggcgcctaataaaggaaaggcgctcgcaacagatgaaaacaaaatgaagaaatcaagtttgtcatcaataaaaatgtcatgaagtacctgcatcccctgcacctttggctcaaatacttctcttatttcttgatcagatttatgaataaaagccggattcgaatgattggctgcaccagcgcaatgaatcaccccgccgattttgccgaacttcagtctcacctttgaaaagaagcgttgtaatgtttctttttccgtgagcggcccggaatacacttccacctgaactcccttttgatccaactcatgcagcagttgtaatttcgaataaagaggtgacttttcatcggtgtcttttaacatgccggctattttatcagattccggaaggtcggttactcccatcaacacaagttttttgactcccttgccggcataatgtctggcaagttctgctccgatccctcttgttccccctgtaataaccagggtttgatccgtacggcatactggcagaccggatagtttccggtttatttccgttgcatgtaatttctcgacgtatggaatataacgttcaccgttccggtagcagatttcactatacagcccgtcagcgcaagcttcatctgtgattacctgtctcaattccgccgcagtcccgacatgcccgtctacatctattgtttttgattttatcttttgatactccgcactcagcattttatatagtccggctgtttcggctccggctaacgacggcttgtcattcagaaatgtctgcagccctctggtcacatgtaaaacgaaaagctgtttacgtgtctttatgatttcctgcagcagtgtcagcttcccgattgtgccggtgcgtaccccgttttgatcactccgcaaatctgacaggtcaatcatgccgatgatttccggattttcttctatgactgctagggccgtttttttggcttctccatccgaatgatcccagttatctgcgcaaatgacagcggattcaatcagaggatctgaatcaaacaattcgaatgcaagccgctcactttcactattagccaggatcatcacctgtcctttcgtaaaagcggaaggcgcagccttttgttttttccacgctttttttaatacatcaaatgataagtcagtcggtgcatggggcaaactttgcggtacacctgtttttttctgtttctgtgctgcttttgcggcaggcacccaatatctgttccgttcaaaaggatatgcgggaagagagataagcttcggtaattccgcagtgtacatctcttcccattgaacgtctcctccgttcacccagtgaatggccatttctcttgcacttttaaagcgggcggctgacagggcatccttttgaccagcgtctcggcgggcctttcccctatataaaccgtttaacttatgatctgaccgcaaatacatcgtcagcttattgcgaaggtcgtcaatgctgctagcctcaacagcgagccgctcttccatagcgtttctcccggtctgcgaggtgtacgcggcatcggctagtgacgtttttggctccagtccttttatatatgcatcaatcaagagtctgagccgttcttcatttttggcagaaagcagaataatttgcgtcttgttgctctgtaccgtttccatcttttcttcattcttatactcttcgatgataatgtgggcattagatcctccagcgccgaacgaactgatgcctgaccttctggcttgattttgcggcgtctcccaatcggtcagttcagactgcacgtaaaacggtgtttcctcaaaatcaatattaggatttaagttatcggaatgaagggaaggagcaagctgtttatacttcatttgcatcagcacttttgtgatagaagcaattcccgccgcagcttctaggtgtccgatatttgacttaaccgaaccaattgcacaactataatcgcttttcgagctgtgcaaagctttggttaaacctgaaatttcaatcgggtctcccaaagatgtcccggtgccatgcgcttcaatataacttatgctgtctgcatcaatccccgccttatcaagagtttcactgatgacgtttgcctgctcgcccggatttggcacagtgtatccgtttgtttttccgccgtgatttacagatgttcccttaatcacaccgtaaatcctgtccccgtcagccttcgcggcagaaagcgatttcaaaagaacggccccgactccttctcccggcacatatccgtctcctcccgctccaaagcttctgcagcgcccatcgcttgaaacaaaatgattttgggaaagtaaagtatatttatccgggtgtaaagataaattcacgcctccggctatggcgagggtggattctcccctttttaaactttcacatgcaaaatgaacagcagaaagtgaagaagaacacattgtatcaattgcaaggctgggtccgtgcaggtcaaagaaatatgacacccggtttgcgatagacgaataagaagacaagagcgcctgacgttcctcatcatctgaagcaccggctgcaaataactgatagtggctgtaggtgacaccgacaaatacacctgtcttatgccgtttcaactttttctttgtgtaacccgcatcttcaaacgtgtgccatgctgtctctaaaaataaccgttcctgaggatcaattaactcggcatcacgaggcgaaattgagaagaacagcggatcgaatttatcagcgtcttttataaaacctccccatttgctgtcatgacgggcattgtcacctgtgtgataatatttccgaaaatcccagcgctctttcggtatttccgttatacaatcttttccggaagaaatattttcccaaaactcttccacatccttcgccatcgggtagcggccggctataccgataatcgcaatatcttcctcggaaggtgcggatggtatgcgggaaacggaaagcttctcccgtttcgccggagccgaatgatcaattcgctgttcggctgccggtaaaaacgccttctgcaactcatgctgatagtgttcaagaaaatactctgacagctcttcaacactgctgtattcaaagaaaagagtcttagacactcttccaaaatatttttccagacgagagttaagacctaaaatcgttagagaatcaattccgtaacggtcaaacgtatcctcgggtaaaatactgtccgccggtcttcccgtttccgctccgacgatctctgtcaaaagacggaccgtttgctttttcagatctttttcatgtaattgcggcaggttactgttgttttcaggcacagtctctatctttttatggtcagttgagagtaattcacttattctatctttgtctccgctgataacagccagctgagaagcagagcggctcatactgtcctgaaaagcggcaagccctgcttgggcggataaaagttccagccctgcatgtcttaaagcctgcagctctcccggcccgactgtcatattgcccgcatcccataacggccaattaatagaaagtgttttcccgggacgtcctttaatgcttcgatactgggtgaatccgtccatacatccgttagcgaaggcgtagtcgctttgacccgcattaggcagaacggccgaaagggatgaaaacataacgaagaaatctagaggctcttcttcagctgctttatccagccaaacggttccgaatactttaggcgctataacttcttctatgctttctttcgttttttttatgataaatgcatccttaacaagtccggcactgtgcaaaattccgtttaattctccgaatgtctgcttaatgtgcttaatcaaagcgtccgtctctttttcctttgaaatatctgccgggacatataaggcttcagcgccgagattttcaagagcgcttaatttttgcgccgtttcacgggaggccggggaacgcccggttaatatcagcttgacttctgcctgtttcgccagatattccgcaaacagatacccgagaccgccggctcctcccgtaattaaatacacaccgttcttttttacactgaaactatgtttctccccaacttctttttttactctttgaagctgccttttataataatgcctcggctcataacaggtaaagcggtccgtcttacattgattgttccattcaaaagagatgacatctgcaatatgctgctttgtaaacggctcgtcaaacattgatttcagctctgcagccttacatgtgaaattcggattttcggcctgtacggtcttaagaaaactttcaaccgcgttataaatcggctgaacctcgccctcggcattttcatacagatacaaaatttctgctttcggacaaagtttgttcgccatgaaggcctgaaacatttgaaacaaggaatacagacttttattgagctgctttctcattgcatcttccgtatttttgaagagcccggcagctaaaaaatgaataatatggcggggtcttatattttgagaacgcagaaccccgcataacgcatcataatcctcatcttttgcaaagttcattgtaaaacgaccgttccggcaatcttcgaaacgctcgccggaagtcacgtaaatgaaaggcgcctcataaccttcaagctgtctcttcattacggtatacatgctgtcgtcttcgcaaaaaaataaaattggctctttcgtatgcgggaattttttactgcctttaaattcatatctatcccataccatttcatatagatgggttttccccaagctcttaattaattccagcccttcttcaggcgtcaggttgcattctttcacctttttcacgatttgctcaatttgcatcgttttttcattcatggaaaagcaactcctctatcagctctgacgtctctttcgtattcatctcacctgtttgtgctttttcaagaagcgacatgatttctccatctgctgtatctttatttgagttgtgaagctcagtgttcgataaagcctcagccttctgcgcttcatctttatttaaatgaatccaatgtctgttcttgctgaaaggataaagaggaagagacagtttaaccggtttgagttcctcctcatacaagtcttcccagctgatttcacaaccgatcgtccacaactgagccagtttggccggcttgttttgctgaatcagtgattgaacatatgcatgaccttcggggccgccgaataaaggagcgtacagactatcaaaatccgttacatttccttcataaacaccttgcagcctgctcccctggatgtaaccgtttaatttttcaagaagatctccggtattcgagcaagtgatcgcaaggcggcattcaaatggttcccttccggtttgcagcgtatatgctatttcttcaagaccgattccggacttttctctaaaattgccgttatgcggtttatcagctgatcgattccggatgctgctgatatagcggcacagctcgctcagtgtctttaattcctgaaatatgtcaagtgatatttctgtgccgtacatttggtttataaaagagattaattcggaataagccaacggatcaaatccgaattccgaaagaggtgtctttgcatctatatctgcgatatctaaacgcaggatacccgctgccgcttcccgaaccgcctcttgcaaatcacgttcctgtacctcttgctgactgaattgaactgatagttcttcatgtaaaaacattgttaactctttggctttaaccatcagcctttcctttgttttggccgaaagaacaatgatttgttcccgctcggcagttactgctttatcttgtccgtattcaaattcttccacgatgacatgagcatttgccccgccgaatccaaaggaactgactccggcacggcgcggaatttcatttccttttcgatctattaatctggcccacttcatagttttattgacaatatgaaacggtgttccgcttaattgaatgtaagggttcagttcattgacatgtagtgtggcaggcaatgttttatacttcatggatagtaatactttaatcagccccggcattccagaggcgggctctaaatgaccgatattcgtttttactgaaccgatgccgcaatattgatcatgattctttcctgaatgcggctcaaaagatccaaacgcttttttcaagccttcaatctcaatcggatctcccagttctgtcccggttccgtgtgcttcaatgtaagatatcgtatcaacaggaatatcggcatttttgtaaacagacgttaacagttctgcctgagcttccgggttcggagcggtcaatgaagcagatcttcctccgtgatttgctccggttcctctcagaactccgtaaatattgtctctgtcattcattgccgcttgcaatggtttcaataacagaacagctgcaccttcaccgcggacataaccgtcggcaagtttatcaaacgtcttacaccggccgtccctagacaaaataccgagtttatcagtatacatatgcgtgactggatctaagagcagcgaaaccccgcctgctaccgccagctcactttcaccattttgaatcgagcgcacagctctgtggattgctacaagactgcttgagcaggctgtatcaatggactcactcggacctctgaaattaaaataatgggatacacgattgctgatgagcgcctggctgtttccggttcccgcaaacgcatgcgccccgtccgaatgcctcatcagcagctggcggtaatcattaaattgaatgcccgtaaacaccccgatatttttgccagacagctttgaagctttgtaacccgcatcttctatcgctttccaggtctcctgcaaataaattctgtgctgaggatccatgagttctgcttcccgcggattaatattgaaaaacgcctcatcgaatttatcggcatctgtgataaagccgccccatttcgaatgtacttcgctgcttcctttgccttcggcgtattttttccaatcccagcgatccgggggaatttcctgaatcaaatctttttcattgattaaattgatccaaaactcatctgcattttttgatcccggaaaaacacaactcatcccgataatggcaactggctgcttctctggatgatggtcagcctgtcttgttgtctttttttcaaacggaaaacttcgcggcggcttcacggttttcccggtggttttcccagcgtgcactactttccttttttcagaaatgtttttttctgcatctgtattcccttttgcaacagtacgcagttcactgtttagaaattctgaaagagacttaatatggctgtaagtaaagaaaacggcaggtgtcagcttaagcttgtattttttattcagtcggacagctaatgttttcaaactgatagaatcaaagccgagattgccgaaattctctgccgtatccagctgtccaatgttaattttcaataattccgataccatttgcttcagttcttccaggacattgtctgtataagccggtgctgtataagaaatttcctcttgacgaacctgaagcgtatttactttttgatgcggcagatcttttcttgctggtgtcgtttcggcatccccggtaacaaccgaaatttgcggacagtcacttgccaaaatcgtctcaaaagccgctatcccttcttccgtttccaaataatcaaacccggatgcggaaagatatgcttcttcagcttctttgtttaaatgcattccgcctttacgccacaacggccagttaatcgaaatgctcttgccttgtctctcttgccggcggctctgttcggatctccaatttatatattgatcttgaaaataattgcccaacgcatagttaacctgtccaaaatctccgaagaccgaagaaatagaagaaaatacgataaagaaatcaagcggctcatctttcgttaattcatctaaacataccgtgccttcaattttagcagtcatgccatctgaaaaatcagccagattcatctctgtaaataaccgatcatcggcatgaccagctgaatggataacgccttgaatagagccccaagtccgtttcgtttcttctatgacccgacccatcgtcttttgatctgcggcatcagcttgataatataccgcatctcctccaagcgcctgcagccggtcaatgttatggcgtttatcagctgttaacggtgaccttcccgtcaatactaattttgcttgatattgagaggctaaatattttgcgaaaatcaggcccagaccgcccaaaccgcccgttatgaggtaaatcccttcctgtttcagctgatgagagtgctctgtatgattgaatacatactcctttaatgtcttaacatacctcttgtcattaatatatttaacttcttcagcctgccgttccacgcctgaaaccatttcgttaagacaaaattcagccattttttcaattgatatacgttctgaaaaaccgattgacttcacattctctgcggatggcaccaacatatttgccgtttttaaacagcctgcaagagcgcccgtatacggatcattcacgccttctttaaaagagtgaacaagaagcagagaatgaagataaagagaggcgtcactgcgggcgctcagggcttttaataaataaaaaattgattccaggccgctgagaaggcggtcacccgcgtaaaatgtttctcccgtgtgcaagatgacatcaggagaaaacccctttttctctaattcttcgaataaacgaatgtaatctgacgtcacttccgggtttacatagaatgtcagcagattttgatcggtctgccgctgatccggcgtgacgagaatgacacggctgtctgattgatttttcagagctccagccagtgcttcatcttttgcaaagaccagaattgtttttggctccctatctttgatctcaatcagaggatttttttgatcccacttatgctcataaaaacgtacatttttattaggcttttcgccaaaaaccagcccgctcagttccatcaaaatcccgccggcattgtctaatacatacatatcataagccgaatcgctttctccagtttgttctgcatatacataaacgggttcagtctcatgatcaaaaatcgtacattctttaatgttttccgggagctctccggcattttcccccgcaaggtatatgacggcttgatatacgctctcaataacttccggtttgattatgcaccctttcggcccggcctttgcttttatttttaaaagtacctgtccgttcctgctgacgcagtgctctgccgctttcagactgtcactgcagctgtatccgaattcggcaagccgctgataaaacgcttcgtacggaatggggtctgcgcgctgagacagaaacggctcaagatgaatatttccgttctcgtacgccccgccttctaattcgagccgccctgaggaataaatggatgagtcgctctgtttttctatagaatacgatgcaccctgattatccggggttaatacaatccggatctgctcattgcttccgctttgtaacatcggttctctaaaggagagctctgttaatttaataatcggattccctgaagccatcgctccggcagctctcgccatttcaatctggctgagaaacggaaacatttccttgtcttgatactttgtttttatatacaaaccggtatcgcttacattgataagaaacttctgtgctttaaaatcagatatattgcatgaaatgtaaggatgcagatcgttattaacgttcatccggcggcttcccatattttgcgcatctattctgcacagctctttggcaaatggatatccgggtgctgatacccgtcttagagtggcatctttataaagtgacggccaatctaccccgttaccgccaacccagtattcagcaatcttcaaaagatctctgtttgcggctgcttcttcaatttcaactttattcatcctttgagcttctgttgtgtctttgccgcttgtaaaaatatgatccgtcgcgtttccgagagtatagtctgtcagtcctttaagcaattcatctcttgtggaggcgataacagccaatctgtgcggcatttcttctctgccggtttgtaaagtaaatgctgtatttctaagtgtttctaatggataatctctggctgctatatgttcttttgcgcgttttgcatattctgccagcctgtcggcattttttgcagaaaaaacaaataaaagctgttcaggttcttcagccgcgagaggagagatagcttcatccgcaaattcttctaaaataacatgggcattagctcctcctgccccgaaagaactgattccggcacgcctgggaacggatgactcccatttttcggcactgtccggtacataaaaaggtgttttttgaaacggtatattttcattcaattcagcagaatgagtcagtgacggaacaatcgttttatgtttcatttgaagaataactttcgtaatgcccgctatgcctgcagcagcctcaagatgtccgatatttgatttaatcgacccgatcgcgcatgttttcttatcgcgttcggcatctgaaaatgctctggtcagaccggtgatttcaatcggatctcctaaggcggtgcctgttccgtgagcttctatatagctgatgctttttggatcaataaatcctttttttaaggctctcgtaatgacctcactttgagctttgggattcggcacggtatatccattcgtcttagcaccgtggttgatggctgttgccttaataactgaataaatctgatcaccgtccgcaatagccttttttacaggtttcagcagcacggcacctgtcccttctcccggcacatagccgtctcctccggaaccgaagcttctgcaccggccatcactggataaaaatccgccttgagtcaggagttcatatttatgaggatgaatggataaattgacgcctcctgcaattgcaatttcacattcattcctgattaaactttcacaggcaaaatgaacagccgttaatgatgaggaacacatcgtgtccaaagcaatacttggtccgctgaaattaaagaagtacgatacccggttggcgattgatgcatatgaggaagaaacggccgcttcgtgaccaacgctgtacagctgatagtggccgtacataacccctgcaaaaacaccgacgttttttcgttcaagcgttttctttgcgtaccccgcatcttctatggtgtgccaaaccgtctctaaaaacagtctctcctgcggatcaattaattcagcttcggcaggagaaatattaaagaacaacggatcaaaatgatacacatcgtcaataaatcccccccatttgctttggttttttacttcatcgcccgctgcgggctgatagtgcagccccgaatcccaccgatcctcaggtatctcagttatacagtctttaccgttcaataagttttcccacagagtatcaagatcatttgccatcgggtaacgtccgctgataccgataatcgcgatatcattgtcatgatacttctcctgctgcacctgatttttcatctggattttctgtttcccgttaacttcggctgtctgttcatgatcttttttcttctgagatggggtgctgctcccgttttctcctaaccggagtttatgaagaagagtatccctgtgctcctcaacgaaatactgtgacaattcttctgcagtctgatattcgaataacagcgtttttgagagcgcgccgaaatgtttttcaagctcattcgtcatattgataatcataacggaatcaagtccgtatttttccaatgcctcttctgcatctattttgtccgcaggcatcctgaattctgcagcaatcactttgatgatgaaatcagatgtttcagctttcagtttctctgaatcaaatgattcgatatttctccctgttccttcatctgcctgaatattgtcttttcgttcatataattgctgaacatgattgtcaatttgctcatctccgtaaaatacagtaaattgcgaaaaaccggaggacaatgcgactgcaaacgcttctttaccttcctctttttctaaaggataaaaacccgcctttttcattgtctctaccgtgcgctcatccacttgcatgccgacttctttccacagcggccagttcagagagagagaaatcgtatcagaattccgggcagaacgcatattcatgaaatgatccatataactgtttccgaacgcgtaatcagattgcccgacatttcccaacactgcggaagtagaggagaagcaaatgaaaaagtcaggattttctttctcaacagcatcattcagccacatcgtacccaatactttcggtctgattacctgatcgaattcctctcgtgacttgttaagaaggaaagagtcacggatgattcccgcgccctgaatgaccccgtttacttttccataagaagttttggcttttttgactacatattcggcttcttccttattggtaatatcagcctgaacataaacagctgaagaaccggtatcctctaatcgtctcagctgttttcttatatgatctgaaagcggagatctccccgttaaaacaaggcagcattttgtttgaaaagccaaatattctgcaaaggtaaatcctaatccgcccgcgcctcctgcgataatatatactccattttctctcagcggcacatctccgcttccggaatttttttcgggttcatacattttgagctgtttaacataacgctgcatgtctttataacggatctctacatctgaaggctggaaatcactcagctcattgcgtatgatatcagctgcgtgaacagctgctattgactgctccatctcaatgctttttgctgagattaacggattttccagctgcaatgtccgcaaaaatccgcttgccgccgcgtaaagaggctgttctccagaaagatgtgaaaaatatccatataacagtttgatcggtttgcggcagttatttttgaagagcgcctgttgtaataaaaacaaagaatagactccgctgtcgcattgttcacgaatcgctctctctgtcttttcaaacggcatgtctgaccacaaatgcaccgcttcccgtatatctgacttctcttcttctataagccatcctaacaggtttatgtaatctctttcagagcgggggtcgatttcaaatacaccgtccccggtttttcgaaactctttccccggcttaaccaaaataacccttgtatcatgcaatgcagcaagttctttactcacatcttcatttttatcaaataataaaaggctgccctcacgccggccgccttttacatgaatgctgagatctgtccgctgccagaccgtctgataatatatcgcctgtccgttaccccctgcggaatgagaaccaagctgctgtatccgctttactccttcttccaaagaaatgatgccgctttctatgtcagaaagtactttttttctaatatgacgggcttctttcataaaaatcttcatcccctttacaaatggcactgccgcaaaatgataaactaatcctgcatacgctccagcgcataatctgcttcctccgcagtcagttcgcccgcttttaattgtctgaggagctcttttactctctcgttctttccattggaatccgctgttgcacgagtctgtgcctccgcggaaaacgtttcttttttacgaatggttacatccttcaaacctgcaagtctttctccttgttcattaagcagctgaatatcgtaaataagctcggattgacctttttggcctgttttacgcgcataaacccagcattctgctgaaacctttttccgaaccgtaacctctcctattgaaaaaggaacataaacagatgcctcttctcttccgtccgtaatgccgaacaaagattgcagagccccatcaattaaagacggatgcaatgtataatgttcaagagcatatgcggcttcttttggcagcaataagtgtgcaaccgcttccgtttttccgccccataaacgctgaatcggctgaaaagcgcgcccatacaggaacccgttttcccgaaaatactcgtaacattcatcttgttcacggacaaaagcacttctgtttatcatctcttgtctgtcgatgttctctatatcatcatcactgtaatgatgatcataatctaattcccccgtcacaaatccagtccttacagcagcatcctcgtcaggtgacatgttaaataatatactgccgtcttttacggaaatgtgagtgtaaatggtcaggctctctttcaaaagcatggccggtctggcaaatatcacgttttttaaacgagtgacctttttctttcgatatgaccgcgttcccgctgcgcatgccatttcaagaaaagcagctgccgggagaatgctcttgttttttacgatgtggtcttttaaccaaatctctttttctcttaatgtcgttttaaaaaactgctgttccagagtagattcattcgaatccagaagcgggtgcagtgaagactgccgcggcaatatttccggaaattctgcactttggtttcgaggcacccagtaagactcctcagcaaatggatataaaggaagcttgaccttttgcggggtatattcttcatataactctctccaatgaatatcagccccgaaagaccataattttgcaagaagattcaagtcctttgtctccatcatcacctcgaggaatttatctttcctcttttgatcatgaaagataaagactttatcaaaatctttcgtaacattccctttgtatacgccctctccaattgttccttcagtacagaaagttctcagcttctccttaagttccggcaaatcggaagctacaacagcaagtctgtcttccatcggttccctgcatgtctgcaatgtaaaagcgatatcagctgccgagacctttgtctcccgctctgtgaattgcagaaggcgccgggcgtattctttcagcctgtcttcatttttggcagagagaactgcggcaaacggaccgcttattgtttgtgtgtccgcatggttttgatattcttccacaatgacatgggcatttgctccgcccgctccgaacgaactgattgctgctctcctgcgggaggcgcctgattctttccgccactcttcttctttctgctgaacgtaaaaaggcgtcttttcaaatcggatattttggttcagctgttccgagtgaatggatggcgccaatttctgatgcttaaattgtaaaagaacttttgtaagggctgctatacctgcggcagactccagatgtccaatattagacttcactgaacctatggcacaaaattgtttatcgtccgtaaatttctcaaacgcttttgtcaatcctgcgatctcaatcggatctccgagcgaggtacccgttccgtgtgcttccaagtagctgacggaacgcggactgatgcccgatttcttgaaattttcagcaatcagctcagcttgtgcattcggattcggaaccgtaaatccattggtttttccgccatgatttacagatgttcctttaattactccgtatatatgatcctgatcagcaattgctttttccaaaggtttcaaaaggacggcgcccgaaccttctcccgggacatagccgtctccgccctctccgaaacttctgcacaatccttcggtggaaacaaaattaccttgactcagccaaaggtatttgctgggatgtatggacacattaacgccgcccgcaagcgcaatttcactttcccctcttttaatgctctcacatgccaagtgaatggccgtcagcgatgatgaacacatcgtatccagtgcaatgctcgggccggagagattaaaaaagtatgaaaccctgttcgcaatagatgaaaagaaggaactgagcgcaatcggattgccccgcgcagtttcttctgcgccgaataattgatattgtccgtacatggctccgacaaacacaccggctttcataccgttaagcttctcttttgtatatcctgaatcttcaaacgtatgccaggaggtttcgagaaaaattcgctcctgagggtccatcagctcagcttctttatgagaaatgtggaaaaacagcggatcgaattgatcaacaccgctgataaaaccgccccacttactgttgattttccccttctccattctgtcgggactgtaattcgctctgaaatcccaacgttcctcgggaatttcaataatacagtttttccctccggcaatgttttcccagaactcctcaagagtatcggaattcggatatcttccgctcacaccgataatggcaatatcctcacccggctgaaccatgctcggtgcagatgtatccttctgctgccggtgctgttttttactcagattttctcttttcttcggcactcttgttaccggagctgcccctgcggccttaagcactttttctttaaaagatgttaggaagaagtttgaaagctcttcaatgttctgatattcaaaaaagattgtttttggaagatccccgaaagtatcttcaagctttgaaataagtgacatgatcataagtgagttgattccgaatttctcaaaagagtccttcgcatttattttatgagcttggattttcaagacaccgctgatgatcttgattaaatagtcatttactttttctttcgcagcatgttcctcttcttcatcgtgttccgccgtgagtgtatcttgatctgctgcagctgtatttctttgaatcgaaagcgcttttatcattttatcccgctttccttctgcaggcattaagctggtaaatgaagaccgcagcattttcagaaacgcttccaaaacagaggaagttcgcatcggagtcattccgtatttttcttttatttggttgattccactgctgtcgagactcatcccgccatctttcaataacggccaattgattgatagggtttttccgtttcgggagagctgagatcgaagcactgcaaaactgtccataaaatgatttgcgtacgcatagtcactttggccggcatttccgtaagcggaaaaagaagaaaagagaacaaaaaaatcaagatcttcgtcttttgtcagctcatccagccagattgtcccgtaaactttcggtttcagtacgtccgtaaaatcactgagacttttatttacaagaaatgagtcacgaaggatgccggcagcatgaatgatcccgtttatgctgccgtaccgctgtttaacgccgaaaatgaatcgctctgcctctgttcgatctgtgatgtccgtccgctgatattcaacaatagagccgctctcattaagcttactgatccgttctttttgatcagctgttaaaaaagaacggcctgtaagtataatcacggcttggttttctttagcgatgtgttccgcaaacagcagcccgagttttcccgctcctccggtaatgatatatatgccgcctttttgatacgttacagatccgttggcgtgttccggaatatcaatatgctgcagccctttcacataacgggtatatgagtctattaaaatctcacattcatccgtttgaaagcgctgtatttcactgattgcagcatcccacatctcggaaaccggaggatttttgtcagaatcctcatggcgtatctgtatgcttttcgctttaagcttagagctttccatgtttaccgttttcatgaaccctccgacagcttcatgaaacggctgattcagaccgcttgtccaataaatatgcaataacgtaacaggttcgtttctccgcattaaagcttttgataataaaaagagcgagttgatccctctgcgaagagtttcattaacggatttttcagtgaattctctgatttctccgttccataaataaagcacgacatcaggtgtaaatccgttttcagccaaatcagacagcagcatttcgacatgattttcatcagaaggattgattgtgcatctattccgttcaattctataatcagaatcgggcgttacgagaatgacacggttatgatctccattcatcatctcggcatgctgaaaaagacggttatcctgatcaaaaatcagcatattccccggtgcctgctgattcggcatatcaatgttatttgttcttacccaatcgttcttaaaaaaaatggttggggacggagcttgtgattccggctccgcctttttttccatttgttcttttctgtaagtgcgaattagctccagtcctgcatcaggagacatttgctgttcttcaattaaggaaagtatttgtttgatctgcactattttccctccagcagctgataaacttgaccagcagaaagttcaccgtttttcaattgttctaataagaagagaatttcctgatcttcatttttacgtcctgcggttaattctcccccggtcacttttctgacagaaaagtctttcatgctcacggctatttcgccgctctcgttaataaaatcaatgttatacgtataaaaaccggtttctctcaccgagacatggcatcgggcagtaagcgtcctcttaatgtgaagctctctaagtgaatatggaacaaataagccgtctttctcattatctcttaacaaaaatgccgccgcttgaaaaccgccgtcaattaatgaaggatgaagtgtaaaatgtgaaaacccgttcgctaaatgagccggaagctccaattctgccattaactccatatcaccgcgatatacggctttcaacgtttgaaaaccgctatgatatgtcaggcccatacgactgaagcggtgataacactcttcccggtttatgaccgccttactgctgcgtttgaacttatcaatatcgacatactcagcattgctgtttatgtctccgaatactgtttcactttgtgtgcagatttgctgcacgccatccggcccctctttacatatcgttacgttcaacttatcttgtttcatttccaagtcggtataaatgtgcagcgtttttcctttatataatataggtctgttccacatcacgtcttttattttagatactttactttctccgcttatttccgcacaaacaagagccatttcaagcgaagcggctcctggcagcacatagtctcctgaaacaagatgatcagtgacgaaaaattcagttccggaaataacagttttaaatgcttgtttctttaatgttgagacattctcgctgattaatgggtgaagacttttgctattaacctcgcttttgttctttttcggggtgaaccaataactctcttttgcaaacggataagttggcagcggcactctattcaatttcttattgccgattgtcttccattcaaactcggctccattggcccaccattgtgcgagcagctcctcttttccgctttgaagagcctcctcaatcatatattcagaaacagctgtgggctcttcagtgttttcgcttataaatacgcctttttgcaccttgctgtcatcaagaaagctgacgtatttatctctcagctcagtcagactcgctgcacatacggcaattctttcgttcattgcttcccggccgttttgcaatgtaaattccatgtcactggcattaacggtcatgtcaccggcaatcacgcgatccaagtactgaagcataagccggatatactcaagtaattgatctttggttttcgcagataaaacaaaaatatgtgtgttaccgttgttttccggcatttctttttgaggttccctatattcctctaaaacaatatgcgcgttcacaccgccgaatccgaatgagctgacacccgctctcctcggcagatcgttgttctctttatcttttatcggattccacttttgagcggtttctgtgatataaaatggcgtattttccagtttgatgtatggattgagttctgaaaaatgggcgagtcccggaagtttgcgatatttaaaagccagtaacactttcatcactccggctattccggcagcggtttcgagatggccgatgtttgttttcacagacccgattccgcagcatttctgtttcgcaaaaggaatgtcccattcttgatataacgttttaaatgcctttatgatgctgtttacttcaatcggatcgccaagacttgtccctgtgccatgcgcttctatatatcccgcagtggcagggctgactcccgccttccgccaagcttcggttaataagtccgcctgtgcgttcggattcggagctgtcaaagaattggcgcggccgccgtgatttacagctgaccctttaatcaaaccatatatatgatcaccgtctgcctgtgctttgctgagcggcttaagcaatactgcagccgccccttcactccttacatagccgtcagcgcttttatcgaacgttttgcactttccgtctttggaaagcatacctgctttatcaaaagctataaacagagtagggcttgtcataatatgcactccgcctgcaatcgccatttcaaaatcgcctctttgaatcccctcagccgcacgatggagtgcaactaacgaacttgaacaggcagtgtcaatcggttcgctcggacccgtcaggttcagctggtaagaaatacgatttgccaatatacaatgatttaaaccggttgcggtctgcgcctgaacagagacaccattttcattcagacgttcagcataatccgttgtggcgacccctgcaaacaccgcggttttcgtccctgccaaatcagacggcttatagcccgcatcttctattgttttccatacagtctccataaaaattctttgctggggatccattaattctgcttcggcgggagaaatcccgaaaaacaacggatcaaaactgtccgcgcctttgataaatccgcctttttttatttttgttctattgacgtccctgatcggatcgccgtcaaactctttccagttccaacggtcttcaggaatgtctgtaatcatatcccgccctttttcaattccttcccaaaagtcttccagcgtatctgtttgggggaaacggccgcttattcccactattgcaaccggctcattcatatgtctttcctcttgcctggttttgttttcaggctcaggggaatgttcataagattccggcggaggcgtgctgtacaatgttttttcgtcagctgcagaaaaagattctgtctcagcaaaaaggatttctccgtattgctcgattacataatcagtcatttcagccagtgaattgcattcaaagaaaatggacggcaataattccgtaccatattgttgattgatttcatttccgagtctggtaaacgtaatagaatcaaatccgtactcgccgaatgaagtctcttcttctatttcctttctgtcaatcttcaaaatacttgacatcatctttgcgatgccctcaatcagattttctctccggtctttcgccgcagattcatctgaagaaaaagaaccgcagagatgaagctcctcggaatactcactctttaaaaactcaagaagttcattaaaatcagtaagaccgaaaaaatctgacggcatcattgatattcctaaagtttcgtttaattcgttgcccagcattgtaaacataattgaatcaaatccgtattcacttatcggcagttcaaaatcaaattcccgttcttcaatttttaatacgccggtgatgatgcgtgtcaaagtgctttttaaagattcagttattgacagctctttcggttcgtgattttcgtcggcgattgccggatcactttttccgctgtcaatcgttatcattcgttccagctttaattcattaccgctaaataccattatttgatgttcacaccctgtcattgcttgatcaaatgctgcaaggccttcccgttttaccagaggcagcattccgaaacggtcataaaggaacttctctgaatgaatatcaatttgcataccgccttctttccataaaggccaattaatcgagactgtttttccaggtttattttccgccgctctcatttccgcaaaataatccataaaccggtttgcataagcataatcagtttgtccggcattcccgattattgcgctgatagatgaaaacataacaaaaaagtccagaggttctctgtctgtataccggtcaagccatattgttccgtaaaccttgctggccaaaactgaatcgagatcctcttcacgcttattgatgagtaatgaatcttttatcacaccggcgctgtgaataattcctttaacaggacctaatttgtttttgacgagttttatcaggttattgacattttccttatcagaaatatcggttcttacataaaaaacctctgatccgtttttttcgagctcttttacattgcttacggcttcctcagaaagctctgacctgccgataaggacaagttttattctcccttttcgcacaagatgtctggcgaaaatcagtcccagaccgcctgttcctcctgtaatgaggtaaactcccccttcttttacttccatcttttcggggggctcggcactttcaatttctgcagagtgctttacctgcctgattccatctctgtatctgatttctgaagtatcatcgctgatgattgtttctttcacaaggttttttaattcaggcagaccggtgttcagctgtaactgaatttcgtcgctgtgtatttcaatatttttaccggacaacataggatgttctaaatgaagcgacctaaaaaagccgctgattgccatttgataaggtaagatttgattttcccttgtgaaaaatacatgtgatatcaggattttatgtcttgggattgttgctaacagagctttcgttacattgaaaaccggcaaaacagcctcttccagcttttcacgaatgttctgctcaattcccgtttcagggctcatcccgattaaaatgacgcggtcaattgtcacttgtctttctttaagaatcgccagcaatttcttatagccgtcaagtttgacgctgttcaattcaaaggaatcagcttctttttcttgaaaactgccgccatggcggacaaagatcatgttcaggccgatatctttatatgcctggcggatcagcggttctgatatatcccgacggagtgaaatcacaaggcagctgtttaaaccgctggcttcaggctgatgaagcataggggcccgcttccacatatctgtgtaatacttaactgaatgccgcttatcctgagtctgcggtgcagcccttaatgccttcaacgctaagttttttattttaagacttacagatccgttttcatccataaatagtatatgaaaccttttgacatcatcatgttgtctttcatcggcagctgtaatataagcaaagccgtttgccgaaggtgcgtgaagaatctccagctcacctaattcaaaaggcaaatatgcggtgtgatcgtcttgctgactggacgtaaaccctgttgtggattgaaaaatgccatccaataaacacggttccagcagcgtgccggattttttatgaatgctctcaggaagtgatattcgtgcaagaacagcattttcatggataaacagctgttttattacctgaaaactggttccatagtccaaaccgctctgccggaaatccctgtaacattcagcgccgctgattaatcttttctgtccggttaaccagctgtccaattgaaaacgctctgtatgagaggcatcttgatctccgcatgtggtaatgtttccttggcagtgaactgccgcttcaggttgcatatcggttttcaccacaaatctgccgtctttttgattcggcagcagatctatcattatcgtcttttctttttcaacggttatcggaaccgcccatacaacctgactcagttttatgactgattttccgtacagcctctctcccgcttctctggccgcttcgatgattgccgctccgggcagaaccgttttcccatgcacaacatggtcttttacataatattcagaatcagaaagcgttttataaaatcggcactcacctgctgaaaaatcaaataaaggagctgtaccggctgctgatgttgtttgcgccttatttgacacccacagtctgttttttaagaaagggtaagtcggcagggcaatttttctcggttttctgccggtgcggaaatcttcccagcttaaattgcctcctgatacccaaaattcagccatttcggttaatctggtgccgccggatttgagcggaagatccgattgctgctgtctgcgtttatgattcggttttttccctctaaatatttcgtgatcgtcaattccattataaaagtgatttaatttcaacatcagatcatcgatattatttgaaatgacagcaagcctttccggcatggcttcacgcccttcaagaagggtatacgcaatatcagaaaggtgaagcggcttgtttgttcccgcttgctgtaaaaactcgccctgcttatgacgggccttttgaagatattcctccagctgttttgctgattcccgtaaactcagtgaatgcttggctgagagtacgataagttcctcactttcctcacgcctcgtatgacagtcagcagcagactcatactcttccacaaggatatgagcatttgccccgcccgctccgaaagaacttaatcccgcacgccgcggatatttgctgtcagaatgtttttcattcgcgggttttatccagtcggcggtttcctgctggaggcaaaaaggtgtctcttccagataaagatccggatgcacccgttcagcatgcagtgttgcggctatttttttatacttcatttgtaagataatctttgtcaggccggcaatacccgcggccgcttccaggtggccgatgttagatttaatcgatccgagagagcaatatgaaacatcttcggtataagctctaaacgccttggtcaggcctcggacttcaatcgggtcacccagcggcgttcccgtgccgtgggcttcaataaagctgacacttctggcgctccaaccggccgctttaagagctccttgaattaaatccgcctgtgcggcaggattaggcaccgtatagccatttgtctttccgccatgattaattgccgttcctttaatgacggcgtacacagtatcattatcacgtatggcatctttaagcggtttaagaataacggcccctacaccttccccgggcacgaaaccgtcgccgccttctccaaaacttctgcattttcccgattttgaaagcatccccatctgacacctgtataaatagtcagaaggatgaagatataaatttactcctcccgcaaccgcaaccgagcactcaccctttgttaaactttggcaagccatgtgaattgccgttaaggatgaagaacaagctgtatctacagggacactgggacctgtaaagtcaaatgtgtaagacactctgttcgcgagagaccatgggaacgaatttggaagtacatcgtttttgtccgtcggtattctttcgccgagcagcttgtaagaattggtcgtcactcccgcaaatacaccgacatgtttttcggtctgctttctcaacccttcaatggtatatcccgaatcttcaaatgctttccacacggtttcgagaaatattcgttcctgaggatccatcgcttctgcttctctcggcgatatttggaaaaacaaagaatcaaatgattcagcattctttaaaaatccgccccatttgcaataaattttcccctcatgcgctttagcggggtctggatcatagtaggtctcataattccatcgttctttcggaatttctgtgattgcggttctctcttttgatagaagctcccacaattcttcgatattttcagccccgggataacggccgctgataccgattaccgctatcccgtcaagatgttctttttcctccgccgcaggtgcagtgatgttttgttccggcctggcgggggtaatactctgaatctgttttcctttttcctcccgtgaaaataaacgccccagccgatccggatattcctttacaagatgatctgctaaatctctgattgtatgaaattcaaataaaagcgttttcgaaattgctcccagtgactgctccagctttgtgttgcattgatgaatcataaccgaatccattccatattcagccagatgcacatcttgatcgatctcttcccgttctgcaccgatctcagaggagatgatattggttaaaaacaaaactgtctgatccaaaatatcgccttgagccaaaggaatggcactgactgtctctgtttcgtccgtcaaaaatctctgccgcataaattgttcaaagcgctcatgatcaccgcagactgcaatattatgcagctgacacgaagttacaatccgcgaaaaccattgcgttccgtcttcagcaggaagttcttcgagcccggaaccatgaaaaagagacgtccgcccttgacctgacaggttcgcccccattccgatgtcttgccataaaggccaattgattgtcagcgtgcggccgctgcgcagagaattttgccgtttctgttcccgatattcggcaaaatgatctaaaaagccgtttgcatatgcataatcacattggccttcgttccctgcaatagagacgactgaagaaaaaacggcgaaaaaatccaattcgagcgacttcgttgcatgatcaagattcaatgcaccatgaactttcggagcaatcacctctgaaagttcatgctttgtttttcgaaaaagcagcgagtctctgataactcctgcacaatgaatgacgccatgaagacctgcatgctgatcggtaataccgtcaatcattttttttaccgcttctttatcggatatattcgcctgtatataataaaccttggctttaaagctgttcaggtattctaaatgtttctgcttatctccgtttaaaacagatcgccccgataggataatggtggatctttcagttttcgcgcaatattcagcgactttactgccaatccccccaaatccccctgtaattaaatacactttatctttttcagggtattgaacggtctttctgtttgtttctctctgcttctctaacatccgtgcatatcttacgcagcccctgtaagtgatatgaatatgccgatcaggcgctgtgtttatttctttataaagaatgtcagccttctctgaaaatgaaacggatgcagaatcatgttcaaagcaaaccgtcttacaatgaagctgcgggtattcttgttttaccgattttaaaaaaccgttcacaccttcaaaatacggcaatttttctttttgattcgcgctgaatgtataaatgaacgttactttatttataaggttctcgctgattaaagccttagtcagataaaacacggaataaattcctgattcgagtgtttcttccagttcaggctgtttttcagaccacgtatgcaaaattgcatcgggcgctgcgcctttttcctttaacagacgaatgacaccttgataatcttcgggacgctgcctgttgatcgtgaaaacactgtcgcttatctgctctaaacgctcaccgggcataataagatatgcggacgtattctctctttttttcagctcttcaaaatagtctttattcccggagaacaacaaaatagtacaagcttgtcggctgcccgcttcattctcaattgcggtttctttccataccggcgtataaagtgcctgattcttcttttctgaaaaagccgcgtctgattttaccggctgagggtttaaagaaaattgagagcgctcaaacggataaggcggaagcggggcttttcttttatgataatcacctagtttcgcccattcaatctcttctcctgaaagccacatttgcataaatgaatgatatagagcctcatcggctggtttgtccgcttcaaaagcagccgctttgtttagttttgctgatggagggagcgatccgaattgaaaaactgaaaaatcagaaatattcacatccggctccgttcccttttcttccgtgtgaagcggcatatggtcagctatctcctgagacacggcatccatttgattgtattctgtcatcaacggaaaacgagttttatcataaaaacctgccggctgctcattaatacaagcaacagcctgtttaattccgtcttgctttttcaataacatgctcagaaaaagttctttagacaagattccttcatccagtaaatttaatatttccagaacataatcattattaaagaatccatcataatctgttaaatcccatctcttatacagtcttctcatagaggcaaggatagccatgatcgccgcttcctcatcagccggcaatgcgtttcttttatccgccgtgcgattcacaatataagataaaatctcgatttcctgagtctttcccgctttatcccactcttctaaaaaccctttaaacgtatattggtgctcaagaagcagccgtgttttcccgtacaggcggtctgcaaaatcagcctggaagctcagaccgttcagcagcatccttacatattcttcatttaatcgaaccggcgggtacgtttttgaagtgtacggattgacaaatggaatggacggcggctcacaggatatgtgcgaaagtttttcagcgcctgtgatgacagaaatggccttttcaattttgatgatatccgctgctgcaagagcgacgtaatatccgtctccggcgcctgtaatgaggcttggcttaaaaccggatgccaggatactttttatgatttccgtattgataactaaagaatacaagcggattttctcaggcgtccattttcttttaaatgaactgtgcaatgttggtatacccttcagcaccggccttactttcttttctaaatcagggaacacccgtttcaaaacggcaaattgtttataactttcccatttgaagtcaccgatggcaagcgcccattcagaaccttgtttcctccgaaaacttaatccctctttaagctgatttttaaattcctccttgctgcctgccaataaaccagccctgtaatcaaacgatgtccttgttaaaagggtgctgctgatcacttcatttgatattttgcaaaattcctctgaatcgtcagcaaaggttctccaatgatgtatcatttgtttcatgctttcttcacttttagcggaaaaaaggaagggtatccttccttttctatcagattcgtcttttgtatgtataaattcttcgatgatgacgtgagagttgacacccccaaaaccgaaggagctgattcccgccctgagcggagccccgtctgccgccttccaatcacttgaatcaagcgccggcctaaacggtgttttttcaaactgtataattggatttaccgtatgtacattcaggcttttcggcaccctccggtgtttcatcatcattagaacttttatcaatccggccattcccgccgctgcttctgtatgaccgatatttgttttcacacttccgatcctgcaatattgagtatcctcagtatattgccgatacgcttttgtcaatgcttctatttctatcggatcgcccagagatgtacctgtgccatgtgcttctacataagaaaccgtcgcagcatcgacagcagcgttgtgtaaagcttctgagatgacccggcactgcgcttctgctctgggagcggttatggaacgggatttaccgccatgattaacagctgtcccttttatgatcccgtatatatggtgaccggcttttactgcatcaccaaggcgctgcagcaatacaacgcctgccccttctccgggaacgtacccgttcgctgctgcgtcaaaggttttacatttgccgtcaggactcagcattctggctttggaaaaagaaatatattttccgggttggaaattcaagtttactcccgatgcgattgcataatcgctttcttttgtccgcaatgacttaaccgcttcatgtaaagcaacaagcgatgatgcacaagcggcatttacagacatgctttttccggtcaaaccgaatgtgtatgaaagccggttggaaagcatagcttcgaaacttcctaaacaggcataactgtcgatttccgattcagcatgacctgtctgccggtagtcagaattcataatacccgcaaaaacagaagtggttttacgctggagatcctgcaaagaaaccccggaatcttcgatgcaccgccaagtttcttctaaaaggattctttgctcaggatccatgtttttcgcttcccggggagagatattaaaaaacttatgatcgaaatggtcagctttatgaataaaacctccccacttgctgattgttttgttcggtatactgatatcagctgaataataaagatcgggatcccaccgttcaatcggcacttcccggatggaatctttgccgctatttatgttttcccagaattcatgataatgatctgcatcggggaatctgcaagcaaccccgattatcgcgatatccgcactctgtttattcaaatgaaccattggcctccacccgccccttctttagtgtagaaataacgtatccaatctgcgccttagcagactttcggtctcattcatcaatttttcaccaatgtcatcgacatgtctgtttctccatgattccaaatccgtgccctttacccaatgattaaaagcgcctaaagacgggccgcaatgaacttggaaattcaccttttgttcttcctgcccttccaaagcaagcagacatcctctctgcaaataccacttaaatagtaacagcatcttatatttttgattgcgctcagctttttgggcgaggttcggctgtttttctattaagctttcgtagatttcatcaaaagttttgttaaaataatcattttcgagctgaatctttgtcttttcatctatctcactcaaagactcatattgttggtagatttgaaataatttatttgccctgaccggaaacagcgtgccctttttcagcacctgaacttttgttccgaactcaaacagagtctccgaaggcgcataagcagtatcgcatattcctgtctcactcagcatttctttaacaaaaccgcttgtttcggcttcaactgtacattgattaatggatcccgtcataataaaatcagcgcccattaaaaaagcagacgcggcagactcgggagtcccgattcctcccgcagccccgatccttatcttccttgcgtatttgtgtgtttccatcatttcatcccgcaggttaacaaaaaacggcagcatcgctggcaatgagccctgttcagtattacttccgcaatctgcttcaataatgatatcgtctgctgccggaatacggctgagccactccgcctgctcttccgtcagcataccgtgctgacacattctctttacgatactttgaggaggcggactcagaaatgcggccgcaacttccggccgtgaaactttggcaatgatccgattatgaggtatgaccctgccgcttttgtctatcttcaactgatgcgctttgtaataaattaatggtgcgctgacagaaagatacgaagacgcttctattactcgtacgtcatgcttgatatataaatctatcaattccttttctctatcttgatgatccggctcaaatcgcagattcattccgtagggctggccatttttgagtgtcttcttaatagaaataagggcctgttcaatttcccttataggtaaacccgctgtgccaaagaaccccagcattcctttcttcccgaggcggatcagcatttcagcggaagagatccctctatgcatcccacctgccaaatacgcgtatgtcaaaccgtaatcttctttgaaagattgatcacccaatcgggacaccggtgaagctgcaccgctctctatattttcagccaagaggctatgctctttcccgctttccgaattgtccttgttcccttcagaaaaaaagagactgtcttccggcgcactgatagtaagcggttcctcatctctttgtatggtttgaattaatttagtcagaatgttgccaggaccgatctcttcaaacagagtgacgccttgtcccattagatacctgatgctttcagtccattttaccgagtttgttatttgttcaattaaattccgtttgatatcttcttgtttataaggtcttgccgtatagttggaaatgaccgggaaattcaattcagaaaaatgaaactcctcgataaattccgcaaattcacgctgtgcactttccatgaaacgagaatgaaaagctccgccgacttgcaatacgatataagctttcgccccttctttttcaaaaaaagaggctgcccgctttatctcttctgcagcccctgctatcacaatttgtgaagatgtattgtaattggcgatatctatttggccgagttcatacttttgaagtattttttttatgtgatgctcatccagtccgatcacggcagccattccgccctcggaagcctcactcattaactcgcctcttttagcaaccagccggagacctgtttcaaaattaaaaacgccggccgcaaaaagcgcagtatattcaccaagactatgtcctgcaacagcatcagggcgggtatgaccttcttttaaaccctttaaatattgcagtgcgctcactgtataaattgcaggctgtgtatacttcgtatcagtcagcctctctttttcatctgaaaggcataaatcctttatggagtatcctaaaatatgatctgcctttttaatgagctcactgaattcatcgaataagtctctgcccattcctttaaactgcgctccctgtccgggaaagacgtaagcaagcatttgttttcctcctgttccgtatttctgccgtttcttttcgttccgattttgattaacgtttttcacttcaattttaaaattgccgtttactctcagcacccttacttaataagcattactaagcaaaataaaaaaacctttatgccggataaaggtttaaaagcaaaaagcatgtacaaatatcatatcgccgtaaatataaatagatagaattttctgataattaaaatcacattttcattctgttttatatatatcaatataataaaaacattccaacgtgccgaaacaacgattggttttatgtgaatatttccctaaataaatattataccatgatttacttgttgtcaatgggaaacacacgtatataccaattcttcagccgcctttttacaggcggctgaactcggttgttatcagttcatcagcccatgccgatatgccttcactatactatttgcggaataatagttctttctctttgttgtagtctttagtaaattgattgaactcatctgcttgtttatgcaccttttcgtaaactgagtttactttgctgatttgctcttccagctgcgctaatgtgagctttttatctttaatcagcttataaaggtccttatcaagtgatatggctttttcgtactttttgtacaaaagatcataagatgcataccttttccccattaaagcgacagcatgcccggctttttcttttactttcttatcctttatttcttgagaagttttttttgcggattcaaacgctttttttgaatcatcaatactgtctttttctgctttcagatgtttttttcgctgatttgcattgctcagagcctgatcagacagtgtgacaattttctggtaatcatccatattcagtttaaccgcgctgtcgtatagctgatgctcttttttctccaatttttctaatgttttctgctctttttgaaacggtttttccgcttgaacggctttttccatcgagtcatgaagcgattcaaccggatcttttcccccgcagccggcaagcagcatacttgcggcgccgagcgctccgattcctgctaatacctttttctgaatcatattcacttagaatcccccaatcttgacaatttccactatagaagcccagacgctttttgacaatagctgagctgtaattggcatgaccgtgtaaagacgcttacggtgctttcaaagaatacttgcgtaaaaaattgagaaaacagggcggatgaccatacatctttttggcttttacatagtttatagtagacgccggccctgctgacagagggtcagcgtaattaaaagaggaggtttttttatgtacggatatggatttggcggcggatttggcggcggttgttgcggcggcggatatggttatggcggcggttacggttacggctgcggcggcggatacggccgcacattcgcattaatcgtcgtattgtttatcttattaatcatcgtcggtgccgcttatttaggctgcggctgctgacattatacaccatgacatcggccggcctgctatggccggccaattgtttcattgcgccgcgataaagaaattcgctataatttacatattaagctttaggagtgaagtttcttgattactatggaaaatattgtacgagacggacatcccgcgctcagagagatcgctgaagaggttcagcttcccgcttctgacgaagaaaaacagcatcttgctgatatgattgagtttgtgaaaaacagccaagatcctgaattagccgagaaatacaagcttcgtccgggcgtcggtcttgccgctccccaaacagacgtaaaaaaacggatgatcgccgtccatgcagaagatgcgaaaggcactttatacagctatgctctttttaaccctaagatcgtcagccactcagtggaaaaaagctacttgacgagcggagaaggctgcctgtcggtagacgaacccattcccggctatgtgccgcgctacgcccgcatccgcgtaaaggcggtgacgcttgaaggagaacagattgacatccgcctcaaaggttttccggccatcgtgtttcagcacgaaatcgatcatctgaacggcgtgatgttttacgaccatatcgataaagaaaatccgttcaaagaacctgaaaacgccattgccattgaccgttaaaaataaccggcacttcccaaagtgccggttttctttatttcaaaaggcccagttctttgacggcccagctgattccttcctcatccaccggctttgtgacgaaatcagcggcagcttttaattccggaaccgcatttcccatcgccaccccggtgccgacaaaacggatcatctcaagatcatttagtccgtcgccgaatgcataagtgtcacttacgccgtacggaagccgctcaagcactcttttaatgccttccgcttttgaaccgcctttcggaagcacatccgttgacaattcatgccagcggacgtaatcaaactccggaaaagcgacatatgctttttcttcatgtccgcggcagaataaaagcagctgataaatttcttttcctttataaaatgtttcatcaacttcgggataaggcgctttcagactgccgattccttccgagacgtgcggatgtccggggacggtcgttttcatcgtgtcttccgccataaatacgacggggtgctccccttctgccgcctgctttaataaacgcgcaaccgcatcttcaggaagcggatttttataaatgacctcaccttcaaatacgacatactggccgttgtatgaaataaatgattcaatctcaagctcttccagaatcggttttaccataaacggggaccttccgctggcgataaaaacgtgatggccagcctctttaagcgccgtcacggcgtttcttgcgctatcgggaatatgtttatcatggtcatagatcgtgccgtcaatatcaaaaaagatcagttttggattcatgtcaatttctcctttttcccgtttatcagtcgtgtctttttcaatatcatcatacagaaagtttttcttccggaaaaccgccttgatgaaattccagttttacccacgaaaacaaattcattttttccgcatactactgctataaaaggctttaaaggaggtatacgatgctgcgccgattacggaagaaactcagaagacagtggggcggaatgctccggaaaaaagtcatcgcgtagaagggatctttcggtttttgaaagtcccttttttgctcgagactttccttataatccgttttcgaatataatagaataagcgagtctaacatacggcatttaaggagagatttggatgatttataaggtattttatcaagagaaggctgacgaagtacctgttcgggaaaaaacagattcactttacattgagggcgtttcagaacgggacgtcagaacgaaactgaaagatcagaaatacaacattgaatttgttcagcctgtggacggtgcttttttagaatatgagaagcagagcgaaaattttaaagtattggagttatgagcggaatgaaatttgtaaaaaatgaccagactgccgttttcgccctcggcggattgggcgagatcgggaaaaatacgtacggggtgcagtttcaggatgaaattgtactgattgatgcgggaatcaagttcccggaagatgaacttctcggcattgattacgtaatccccgattacacgtatttagtaaaaaatgaagataaaattaaaggtctgtttatcacccacggtcacgaagaccatatcggcggtattccgtacctgctcagacaagtaaatattcccgtttacggcggtaaactcgcgatcggcttacttcggaataaacttgaagagcacgggctgttaagacagactaaattaaacatcatcggtgaagacgacatcgtgaagttccgcaagacgtcagtatccttcttcagaacgacacacagcattccggattcatacggaatcgtcgtcaaaacaccgccgggcaatatcgtacataccggggactttaagttcgatttcacaccggtaggcgaaccggcaaacttgacaaagatggctgaaatcgggaaagaaggcgttttgtgcctgctttctgacagtacaaacagtgaggttcctgatttcaccatgtcagaacgccgcgtaggcgaaagcattcacgatattttccgaaaagtggacggcagaattatatttgcgacattcgcttcgaatatacaccgtcttcagcaggtgattgaagcagccgttttaaacggcagaaaagttgccgtattcggacgcagtatggaatcggctattgaaatcggacaaaatctcggttacattacctgtcctaaaaatacgtttattgagcataacgaaatcaatcgtatgcctgccaataaggtaacgattttatgtacgggaagccaaggtgaaccgatggcggcgttatcacgtatcgctaacgggacgcaccggcagatttccattaatcccggagatacggtcgtcttttcttcctctccgattcccggaaacacaatcagcgtaagccgcaccatcaaccagctgtaccgtgcgggcgcagaagtcattcacggttcattgaatgacattcatacatccggacacggcggacaggaagagcagaaattaatgctccgcctgatcaaaccgaagttctttatgccgattcacggtgagtacagaatgcagaaaatgcacgtcaaactcgcgactgattgcggcatacctgaagaaaactgctttatcatggataatggcgaagtgctggccctcaaaggcgaagaagccgctgtggcaggcaaaattccgtccggctccgtttacattgacggaagcggaatcggtgatatcggcaatatcgtgctccgcgaccgccgcattctttcagaagaaggccttgttatcgttgttgtcagcatcaatatggacgactttaaggtttcggcggggcctgatttaatctcaagaggttttgtatacatgagagaatccggtgatttgatcaatgacgcgcagcagctgatttcgaaccatctggagaaagtaatggatcggaaaacaacgcagtggtccgaaattaaaaacgaaattaccgatacacttgctccgttcctatacgaaaaaacaaaacgccgcccgatgatccttccgatcattatggaggtctaaaaaaactgcactcgtaatgagtgcagtttttttattgcagcggaatatgctgaaaggctttgacatcaaacagaccggctgctgtcattttaatatccggaatcaccggaagcgctaaaaacgataatgtgagaaacggattgaaatcaccggtgaatccgagcagaggaagcttttcatgaagtacgcccaagctgtcattgacccattccgccgacttatcagacaaaagcccggcgatcggaagcggaacggagtgaagcaattctccgtttttcacggctgttaatcctcctccggtgtcacggagcctgttgattgcttttgccaaatcggcatcgtttgtaccgacggcgatgatattatgggaatcgtgagaaatggttgtggcgatggcgccttcttttaacccgaacccttgtacaatcccgagtcctatcattttttcgccgctgtgccgctctgtgacggcgatttttaataaatcattttctgtatcaggacaaaacgcgtcagcagacggtgcaggcacttctttttttctcgtctccaaatgattcggtatcatttcgattactttcattttcctgccctcatgaatcggcatataaaaatcagattcagtcagcggcgatctcagccgcactgtatccaacagcgcctggtccggcgaataggaaccggcagactgttcataaaccgttcgtccgttctcggcaacggtccggccggcgaccatggtcttcgtgacggcagcctcccgtacatctgaaatgaacagcagatctgcgtcaaaacccggcgctaccgccccttttgtttcaaggccgtagcactcagccgcatttaagctggcgagctgatacgcaaggaatggatcaagtcccgcctttatcgccattttgacttggtggttcacacttccttctgaaagcagatcatctacatgcttatcatccgtacaaaagaaaaagcggcgcgcgtttttttcattcactgccggcagcacattgagcgtattttttgccaccgatccttcgcgcagcatgacatacattccccgtctgattctgtccagcgcttcttcttttgtcgtcacttcatgatcatttgacaccattgcggttctgtatatattgatgatatctgaagacagtccggctaaatgcccgtcgatccgttttccgtgacgcttggcatcaagcagtttctgaagcatatcctcttcaccttccgcaacagacacataatccattacttccgcaagtccgagcacctctttctcctgataaaaaggctttaaatcctcggcttttaatacggctcctgagcgttcaaagctagcggcgggaacacaggaaggaagcatgaaacggatgttcagcggcgcctttttcgcctgctctatcataaaagaaatgccttttgctccggaaacgttcgcaatttcgtgaggatcagtaatgacagtagtcactccgtgtgggaggacggctttagcaaattcaatcggagtaaccatagaggactcgatatgaacatgtccgtcaataaagcccggaacgatcatttgaccttctgcatcaatgacttcttccccttcatattcgcccagcccgacgatcactccgcccgtaatggcgatatctgcagaaatccattcctggttaaatacatccatgatttttccgtttttaatgacggtatcggctttttgtctgccggctgatgcattcagccgttcagccagtgtttctttgttcaaaatgaggcctcctctttttctgtatatggtacaatatgctatcggatcgcctgatcatagtcaataaaaattgcagaaaataccgcttacacgataatgtctttctattctgacataataaaagaccgtccttttacggacggcttttcactttgtgtgaagcactcttttttcaaatcgggaaatgtccgtaagagagccgataacgatgagaatatcttctttttggatcatttcagtcgccaggggagatacgatcacttctttttctctcttgatggccacgatattaatgccgtacttcgcccggatgtccagatcaagcagtgtgttgcccgcaagcctgctgttggccacgatctccacaatgctgtgttcgtcggacagctccaaataatcaagcacattatttgatacgatgttgtgggcgatgcgttttgccatgtcacgttcagggtggacgatgtgatcggccccgattttcgcaagcactttctcatgataatcgttctgcgctttaaccgtgatcgtgttcacgccgagttcctttaagatcagcgtcgttaaaatgctcgcctgtatattttcgccgattgccacaatgacgtggtcaaagttgcgcagccctaagtttttcagcaccgattcatcggttgaatcgccgatgaccgcgtgtgatgcgattttggcgtattcatttactttatcttcatcaatatccatcgccatgacctcaaggccttcttcacttaatgctttgcaaatacttccgccgaagcgtccgagaccgataacggcaaactcttttctcataacagtactcctttaaacaatatctctaataggaatagtatcacattttcggcaatgagttcatatagcgtttaagcttttctgaaaaggcgggcgataaatacagatccgctccgcgttcgatttcttcctgatagtgacccggaggcgcaatttcctcagctttatcaagaacgagaaacgtcaggacgcctctgtatacacggccgccggcacacacttctatgaacgcgggacggtatgtgtggttatcaacaccttctcttttgtacagataggttgccgcttcaaacgggagcttgtacagcacgccttcagttcgtcccccgtcttcaacaagatcggctctggaaccgtcaggacgccttaatgtgaatctcgtcgaatacccttcaacaaccgcccctccgaccggctcggcaaaaaagtggtcgacccccgcctgtttaaaccgggcattgtccatacaggagccgtaagcgaaataataaaccggactgtcatcctcccgtttcataaaacggtattctttccagtctccgcttttgatacggctgaatgaagcacactggtcgggctttacgacatatgcgaaggcggttttattcccggcatccgtcgtcacggcaacctcttttcgatcaaaatcagcataatacgcatccagcttacggatcatctgatgatctgtttcatacaattccccgtacacaaaagctgtttcttctaaagacgccgcaggctgacctttatccgtttcgtacagcacgccgtttatcgcagcctgctcgcacacacacggagcgcctttcagcagttcatggttttcttcacgcttccgtaacaaaccgtatacaaaaagaagcaagttatttttcctccttttggacagcagccgcttctaacggcagaatcacctgaaacgtactgccttctccatttttgctcttaatgttaagtttaccattatgctccttcagaattcgtaaacaaatcggaagcccgagacccgttccctgatcttttgttgagaaaaacggtttcccgatgttttcaagcttttctttcgacatgccgtttccttcatcctgtatgctgatcaccgcgtattcttcatcccgttttgtataaatatgaatattcccgccgtcaggcatcgcttcaatcgcatttttaataatattgataaatacctgtttcagctggttttcgtcaccgttgaccatacaggactcagtctgcctgaaatccttctcaatcacagtgttcgacagcaccgcgttcgtgtcaagaagcgtcgccacctgccgtaaaatatggttgagatgatgagcggtaaacgtcacggtctgcggcttggcgagcagaagcagctcccccagcacgagatcaatccttttaatctccgaaaaaataatatcaaaataatccgttctttccggatactgggctttcatcagctggagaaagccgctgactgacgttaaaggatttcttacttcatgggcgattcctgccgcaagctccccggcaatggccagcttttgagattgcatggcgaggcgttcgttcgtttccagaagctcatcgacagcttttttccgttcactgatatcagacatcgtccccaggcttccgacaaatttctgtctgcggtcataatacagcttataatggacttctccccaaaagatcgagccgtctcttttaatatatttggccgtaaacattcctgacggggactgctgcttgatttgggagataatataatcaatgatatgtttttcttttataaaataatcattatacatcgtgcccatacattcgctgatggagtggcccgtaatcgccgtccaggcctgattcaaatatgtaatattcccttgagcatccgtctgaaaaacgatttcctgcagattgtccatgatccggtttttctcatctgaaagcgcctttgctttctgctcgctgtccttcagctccgccagcagctgctttttattatccacataataagccagcagccagacgctgattaatgtgacggcggtaaaggtgatgtcaacgggccagttaatcggattccgttcaatcatataaaataaataatcccaaaacataataaaaatcattgccaagattaaggaaatgatacgcgcttgatattttcccatagtcccacctgccgctagcatttctacatatattgtaacattgttgactgcattattgactaaaaaatgataactattcccaattaattgagcaggttcgcttacttttcccgtgagtttttgcacaagttcataataaaaggacggaatgatgctccgccctttttgctgattatgatctatcttttaacgcttcctcgatttcctcaagcagcattttcgctccttcaggacttaaaataattttgccgttgccgtactcctgattttcgggagtaatttcccccgtcattaagcaaatgccgtgcggcttgtattttttcaagacaattttgtctccgtcaacgaaaaattcaatactatctttaatagcgatatccaatgctcttctcaattcaatcggcatgacaatacgcccgagttcgtctacttttcttactacaccaattgatttcatagaaatcccctacttcctttaatgtctcttctttatgtccaaggaaaatccttcataaacgtagacgaaaggaacggagcaaaagtttctcagcatccggaactgaatgtttttttacagaagaaaatccttttgaaatatgggatacagactttccctccttttttacaaaaacatttcattcccggcggaaacccccaaaaatcgtggtttttctcagaaactttaaatgtagaatcaattaaatcaggatagggattgggtgaaaacatgtttcaatcaactgagatcggaatcgacttaggaaccgctaatatacttgtttacagtaaaaataaaggaattattttaaacgagccttccgttgtcgctgtagatacaacaacgaaagcggtgcttgccatcggaacggatgccaaaagcatgatcggaaagacgcctgggaaaatcgtcgccgttcggccgatgaaagacggtgtcattgctgattatgatatgacaactgacttattaaaacacattatgaaaaaagccggaaaaaaaatcggaatgactttccgcaaaccgaatgtcgtcgtctgcacgccttcaggctcaacagccgttgaacgacgcgccatcagtgacgctgtcaaaaactgcggagcgaaaaacgttcacttgattgaagaacccgtagccgctgcaatcggggccgacctccctgttgacgagccggtcgcaaacgtcgtcgtagatatcggcggcggtacgactgaagtcgccatcatctcattcgggggcgtcgtatcctgccattcgatcagaatcggcggcgaccagcttgatgaagatatcgcctcgttcgtcagaaaaaaatacaacctgctgatcggggaacgtacggcagaacaagtgaaaatggaaatcggatttgcattgatcgaacatgtgccggaaacgatggaaatccgcgggcgtgaccttgtaaccggtctgccgaagacaatcagactgcaatctaatgaaattcagcacgcgatgcgtgagtcgctcctgcatattcttgaagcgatcagagcgacacttgaagattgtccgccggagctcagcggtgatatcgttgaccgcggcgtcgtgttaaccggcggaggctcccttttaaacgggatgaaagaatggctgacagatgaaatcgtcgttcccgttcatttggcggcaaatccgcttgaatcagtggctatcggcacgggacgttcattagacgtcatcgacaagctgcaaaaagcgattaaataataagattgtgcttcttttttctccggccggctcatattgtgagaactggagaaacattaaggaggaagcatatgcttagagatgtgggaagacgcgtagcagtagccgtcattttaagcggaattattttggggggtatgagcatttcactggccaatatgccccattctccggccggcggcgccgtaaaactgaatcacccgtaaagacgcagcaaaagctgtgtctttttcgtttgtgctcctttctttcctttatgaggcgatatttgatatgatgagaaaaaccgatgaggaggaatgaacgatgagttcgtttactgaaaagttacatacatatgctcagctggcggtagaagtcggcgtcaatgtccaaaaaggacagcatgtcgtaatcaatgcctcaactgatgtccgggaacttgtcagactgcttgccaaacattcttatgaaaaaggcgctaaaaacgtcacagtaaattggcaggacgatgaactgtccagattaaaatacgagatggcaccttttgaagcgtttgaagagtatcctgaatgggaagcaaaaggaaaagaagagctcgcgaaaaaaggggctgcgtttatttctgtcgtctcatccgaccccgacctattaaaaggcactgacggcaaacggattgcagcgttccaaaaagccgccggaaaagcattgcatacatacagacaatatattcaatcagataaggtcagctggacggtgatcggagccgcttcaacaggctgggcgaaaaaagtgttcccggatcagccggaagaaacagccgttcagcttttatgggaagaaattttcaaaacgacccgcgtaaatgaagaagaccctgttgaagcatggaaaaaacatgatcaaaaccttcatgaaaaagtggaacacttaaacaaaaaacattacagcgccctgcattatcaggctgaaggaacagacttaaccattgaactgccgaaaaaacatgtatgggcaggcgcaggaagcgtgaatgaaagcgggcacgaattcatggccaacatgccgacagaagaggtttttacccttccgcagcgtgacggggtgaacggcacggtttccagcacgaaaccgctgagctacggcggcaacattattgataacttcactcttacctttgaaaacggccgcattgtcgatgtgaaagctgaaaaaggcgaggagattttaaaaggcatcgtcgaaaccgatgaaggctcacactatctcggtgaagtggccttagtgccgtacgattcaccgatttcacaatcaaatattttattttacaacacactgtacgatgaaaacgcctctaaccacttggcgatcggcagtgcgtatgcctttaatattgagggcggcaaacaaatgacacgggaagagcttgtcaaagagggcttaaatgaaagcattacacacgtagattttatggtcggttccaaagacatgaatatcgacggcattaccgcggacggcaaaagagaaccgatcttcagaaacggaaactgggcattttaataaaaaaaggaggcgatcaggcctcctttttttatttcgcttcatacatttgcaagttggcgcagacggtttccaaaacaggtgtatcaactgccaagcctttcgctttctcaagcaaaaatccgtgtaaatgatcaccttccgtcaccctgcccttttccatatctctcagcatcgacgatttcatatggtaagacatgcttgtcaatgtgcgataactctcttcttccagaccaggatctttcgggatgccggcagccttgaaaatggctccgatttcagcaaagaggcgctttgccgtgttgcggccgccttctgtatctaaaatcggtccgaccggctgttgaaacagagtggtcactcccgcctgcgcggcaataaacatatattttttccaaatgtccttttcaatatcccggctgatgatgacatccgctttcacacctgcaaatgcgttttccagctcgttcatacgttctgtgcgttccccgttccattcaccgaaaacaaagcggtgggcagcgctcgtatgaagaatttcccctttgtcgttaagggcgctctcaataaagcagaggccgcccagcacctgccgttttgaaaaagcttcaaacagctggtgatagtgcctgtatccgtttaaaaaaggaataatgaccgacgaaggtttgacaaacggtttgacatcccgaatgacgtcctgcaaagaatacgcttttgaagcgatgataaccgcgtcaaatgctccttcttcgcccgccatgattaatttcggcttgattgaaacatcacctttttcacttttgacggtcaatcccgtctcttgtaattgttccgcccgtttcttgcggacgagaaacgtcacgtcatttcccttttctgcaagacgcgcgccgatatatccgcccactcccccagctccgacaactaaaaacttcatgatgcattcctccgtctcttttcaagttatgtattcatttattgtaacgggaagtcagaagattgaaaacttttttcataaataaaaaagcagagtctcccctgcttctttattacgcgtatagctcttcaagctttttctgtacatccgcgttttcaagaaattcgtcataagacatttgtttgtcaacaatgcctttaggcgttaattcaatgatgcggttggcaattgtctgtacaaactgatggtcatgagatgaaaacagcatagcgcctttaaagctgattaagccgttgttaagcgccgtaatggattccaaatctaagtggtttgtcggttcatccagaattaaaatgttcgcgccggaaagcatcgcttttgaaagcatgcagcgcactttttctcctccggaaaggacgtttgattttttgttgacttcttctcctgagaacagcatgcgtcctaagaagccgcgcagaaagctttcgctttggtcatgcggcgagtattggcggagccagtcaacaaggttcgcatcgctgccgtcaaaatactcgctgttgtctttagggaagtacgcctgagaagtggtcacgccccatttaaatgtgccgctgtcagcttccatttccccggaaatgattttaaacaatgtcgtaacggcaagttcgttgcgtcccgtaaaagcgattttatcttctctgttcataataaagctgacgttatcaagcaccttaaccccgtcaatcgtttttgttaagccttcaacccgcagcacgtcatttccgatctcacgttccggcgtgaaattgacataaggataacggcgtgatgacggtttgatatcatcaagcgtgattttatcaaggagtttctttcttgatgtcgcctgctttgatttagaggcgttggcgctgaatctggccacgaactcctgaagctgtttaatctgctcttcttttttcttgttggcctcctgagaaagctttaaagcaagctggcttgattcataccagaaatcatagttgccgacgtatacttgaattttattaaaatcaagatcggcgatgtgcgtgcacactttatttaaaaagtgacggtcatgggatacgacgatgactgtgttctcaaagttgattaaaaactcttccagccactgaatcgctttcagatccaagtggttggtcggttcatcaagcagcagaacgtccggcttgccgaacagcgcctgtgccaagagcactttcaccttttctgaaccgcctaagtcagccattttcttcgtatgcaggtcttcagagatgcccaggccctttaacaaaatagcggcttcactttcagcttcccatccgtttaattccgcaaactctccttcaagctcagcggcgcggatgccgtcttcatctgaaaaatcaggcttcatataaatcgcgtctttttcctgcatgacttcgtataaacgtttatgtcccataataacgactttcagcacttcgaagtcttcatattcaaagtggttctgcttcagaatggcaagacgttcgcccgggctcatatggacatcgccggtctgcggctccagctcaccggataaaattttcaaaaatgttgattttccggcaccgtttgcgcctattaatccgtagcagttgcccggcgtaaatttaatattgacatcttcaaataacttgcgatccgcaaaacgcaagctcacattatttacagcaatcatttagaatcctccatcgtgtctatcatcattaaaagtataccatgaataaaggggaagagaaatgtttccctgcgaatatacgggtttgaaaagatgcaggcaaacccggagccctgtgatacaatagatatatatacatattcatcacggaggaacaagttgaagcttttaacactcacagaatattgtcttatgattttctttaccggggtttttctggccgtcacaggctttaccgcacgtgacatcggcttgtacgtcggaatcgccctcatttatacgttttcgcatctcttttcaaaacggatgcttgaaaaacgcggcaaagagaagcagcaggtgaatctttttttcagcgttctggccattgtcggatcagtgctggccacggtattgttcatcgccgtcgccgcctcgtttgccaaataaaaaacgcctgctgtccaaatcgggcagcgcggcgtttttattttgtctgacgcatatcatgaaatgggaagaacacaaacttcgaggtgccgacgatccggttttcggcaattaaaccgagtccgttccggctgtccattgagttcagccgattgtctcccatgacgaagtatttgcctttcggaacctttacggggccgaaatctcccgtcaggttgactcccagttttttcgcttcttttttattgctcgcgaggtacggttctgcgatttttttgccgtttatataaagcgtgtcatttttcatttccaccgtttctccaggttttccgatgagccgctttacataatggactttcgatgtatcgccgttaataatgacgatgtctccccgctcgatttctccgatataattgacgcttttgttgacaaacagcctttcaccgtcatgtaatgtcgggtacattgatgatccttccactaagtacggttcaaacaggaaatggcggattaacagcgcaagtgcaaccgctataatgatggcctttccccattcccaatatgtgttggattttctttttaccgatttttcagaagtaggtttttgttcttcagtcaacgtggttcctcctagacgatcactgtttcagttcatgtaccatctttactttatcataactcatcataaaatacataacgcttctatgcgtacatgattgaaaaaagcgcccgtaaaggacgctttttgcttatttctctacaaccggttttttgacgattcccaagataaccgccgttataatcgctccgatcacgatgctcattaagtaaagcagcggatggttcgtaatgaatgcaacgaatattcctccgtgcggtgcaggaagcgttacccggaaaaattctgtcaacccgcccgctaccgcagaaccgacaacggctgcagggatgacgcgaagcggatcagccgctgcaaacgggatggcgccttctgtaacgaaagctgctcccatgaagtagcacgtaataccggcttcacggtcacgtttagagaatttgtgtttaaagaatgttgtcgccagtgcgattccaagcggcggagccattccgcccgccatgatggccgcatgcggcgcatagtttccggcatcgatcatcgcaattccaaaagtgaacgccgctttattgagcgggccgcccatgtcgatagccatcataccgcctaaaataatacccattaaaacaagatttccagttccaaggctttcaagccaatttgttaagaaattcataaacgctgcgacaggagtgtttatgacaaattgcatcagaactcctgtgataaaaataccgagcagcggataaatcaatacaggttttaatccatcaagagattgaggaataaagacaaacagctttttcagcaggatgacgacataaccggctaagaatccggcaatcagtccgcctaagaatccggcattcgcctgcgtagccataaatccgccgaccatacccggcgcaaatcccggacggtccgcaatactcattgcgatgaatccggcaagaactgcaacaatcagctttaacgcattaccgtcaccaataaagttcagtgctgcagcaaacgtgttgtatgtcgggtctttcggatcagctgaatgaattccccagaagaatgagatcgcaacgagaattccgccgccgacgacaaatggcagcatgttgctgacaccgctcattaagtgtttatagaaagtacttccgatgcttgttcctgatttctgtttcgggccgtcctcatttgaagcggaagatcctccgccgctgccctcgtaaatcggcgcatcttggttaacggctttttcaatcagttcctgaggacgtctgataccggccgtcacaggcacttgaagaacatgtttgcctttaaagcgttccatttcaacctgtttatcagccgccacgataatcgcaggcgcgtcttcaatttcttgagccgtcagcttatgtttgataccgcttgagccgtttgtctcgactttaatgtcaacgccgagctctttcgctttttccttcagtgcgtcagctgccataaacgtatgggcgatacctgtcggacatgccgtaacggcaaggattttgccttttcctgacggcgctgcctgttcttcctgctcttcttcttcctcatcgtcatctttgtcatgctgattgatgatgtcaatgatcgcatcttctgattcagcttcaagaagctgtttgcggatttcctcacgcatgagaagcgttgaaagtcttgataatgcctcaaggtgcgtattattcgctccttcggttgccgcaatcataaagaccaggtgtgccggctgaccgtctaatgattcataatccacaccatcttttgaacggccgaatgcgatggccgggttaatgacgctcgccgtcttcgcatgaggaatggcaatgccttcgccgattcccgtcgagctttggctttcacgatttaaaatggctgctttgtaagcctctctgtcatttaatctgccggctttgtcaagcactgtcaccatttcatcgataacgttttctttctctttgctttctatattgagatgaattgtatctcttgttaacagctcagttatcttcacttttcttttcctcctctatagacgtgtgactttaacttcaggaagaagctgctgtacaaactcttcagttccgagttcttcagaaaatgccgtcgcgcttccggaagcaactcctaaacggaacgcatcttccaaaggcagctgttttgaaattcccgcaaggaatcccgcgacgacggaatcacccgcgcctaccgaattgacaagctttcctttaggaacattggcgaggaaaaccgcctctttcgtaaataaaagcgcaccgtcgccagccatcgaaacaatcgcatgttcagcgccttgttcaatcaattttttaccgtaaggaacggcagcttcggctgaatcaatgaccgtattgaacatttccccaagctcatgatgattcggtttcatcaaaaacggtttcatttctgtcgctttcatcagcgcttcaccggagatgtccaccactacccgggcattctgctttctgcatgcctcagcaattttttcatacgtgttatgcggcagggaagaaggaatgcttcccgctaaaacgacgatgtctccttcttccagagcggagaactgttctaaaaaggcattgaacacttcgtctgaaatcgtcgggccctgtccgttaatttccgtttcatcgcccgttttcagttttacatttatacgcgtgtcttcatccacctcagaaaaagccgtttccagaccttcctgctgcaaaaatgacgtgatatagtttccggtaaatccgccgacaaatcccaatgcttttgacggcacatggtgtcttttcagtaatctcgaaacgttgatgccttttccgccgggatacttcgtgtcatagctggaacggtttaaaccgcctacggcaaaatcttcaacgtgaacgatatagtcaacagacggattgagggttacagtgtaaatcatggtttcactacctttacgacagttttttcttggtaattatcgaatgcaagttcttcagcttcagtggtaatgatagcggcatcgcccaaggcggcgaacgctgcgaaagaaatctcgccgaatttagaaggatcggctaaaacatacgcatttttcgcctgtctcacagcctttgtcttcagaagagcctcatccggatcgggtgttgtaaagcctgcttcaatgtgcacgccgttcaccccgaggaagcttttgtcaaaacggtactggctgaccgccgttaatgaggcgccgccgatcatcgcacctgttctatgcttcacatatcctccgagaagataaaaggggatccctttccttattaaagcgtcgatatgcataactccgtttgtgacaaccacaatgtccttagatggatctataaaatcaatcatgtgcaatgtagttgttcccgcatcaagataaatacagtcaccttcttctaataaagatgccgcttcttctgcgatcttcagtttatcctgaaggtttttggaggatttttcaagcatatcgggttcttgcctgctgttggaaagtttagacgccccgccgtgaacgcgctttaaaaatccgcgctcttcaagtgttgataaatctcttctgatcgttgattcagaagcatttgtcatgcttatcagctcttgaatcttcaccacatcacgcttttcaatctgatcaataatcagctgatacctttcaggagtgagcatattccgcctcctttggaaacgtattcatttcggctgcaagataattgtaaacgctttttttacttctagcaactaaaatcactcaaattcattcaataactatcaaaatctttcacatttgttcatattaacgtatgtacatagggtttgtaaactgtaaattcgacaaaaagggggacaattgtatgacattttctttttatcataaatgaaaaaagtctattatattcattcaatcattaaaacacaaaaaaaccccatgcagactgcatggggcgccggttattcataccgtaacgcttcaatcggatctaagcgtgatgctttgttggcgggcagcatgccgaaaatgacaccgatcagcatactgaacagcacaccgatacaaaccacctgccaggaaacgagcgacggccagcctgcgataagggaaacgagtgatgctcccccgtagccgagacagattccgattaagccgccgattaatgtaagcacaacagattcaattaagaattgtgtcagaatctgtcctctcgtggcaccgagcgatttgcggatgccgatttctcttgtccgttccgtcactgatacgagcataatattcatgaccccgatcccgccgacaacgagagaaataccggcgatcgaaccgatgatcgtcgtcataacggtcgtgacctggccgattcccgccgctatttcttccatattcatgacttgataggcctcttttgtaccgtgattgtcatttaagagacgggccgcttcttttcctgttgatttgatttgatcagcggactccgtctgaacggaaacgttgctgtagtcgttagtaccgaaagacgttttcagcatgttgaacggcacatacatttcactgagtcctaacgataaaaagccgctctcttctttcagtacgccgattacttcaacgggctgtccgccggcccagacgatttttccgagcggagacgttttcccgaacagcttttcagccatttttttcgagatgattcctgctcttttcccggaaagaaaatcattgtccgtaaatgtccgtccatcttgaacgtccagcttttttacgtccatgtagccgctgttaatgccgttcagcgtaatatccgtgtcttcttcatggtaacgggccgtcatggattttaccgcggaagcgacaacctgctttacgccgtccactccttttaatccattaatatcttcttctgtaaaactcgcttgctgtaaggcgttcggattggctgttaattcttcatcactgggcatgtaaaacaattcaatcgtattgcccggcccgctgatggattgcttcagcatttgctctccgccctggccgacagccacaacaacaattactgaaccgacgccgataatgattccgagcattgtcagaatcgatctcagcttgtgagctcttacggaactgagggccatccggagattttctgacaggctcattcccccactctcctctgctcagcatcgcgggaaacgatcatgccgtcacggacgaaaatcactctgtttgtacagtccgccacttcaggctcatgagtcacaagcaccacggtcacgccctctgcattaagctctgtgaactgctccataatggaaatgcttgttttcgtatccagcgcgccggtcggttcatcagctaaaatgagcttcggttcgttcacaatggctcttgcaatcgcgacacgctgcttctggccgccggacagctcattcggcatgtgacgcatccgatccgccaaaccgactttttccagcgcatgctcagcccgttcctcacgctcttttttgccgataccggcgtagatcatggggagttcgacattttttcttgcattcaatcgcggcagcagctgaaattgctgaaagacaaatccgattgatttgttccggaccgccgcaagctctttttcggtgcatgaagaaacatcttcgcccgcaagcctgtaactgccggacgtcggtctgtccagacagccgatgatattcatgatcgtagattttcccgatcccgacggtcccataattgacacatattctccttcttcaatcgtcaagtcgattgaacggagaacatcaaacgtctccttgccgatctgatagctttttttcacctttgaaagctgaatcatctatgctttcacatccgttccgtcagtcaaaccgtcagccggattcagaatgactttatcatcctttgaaagcccttcttttatctccgtaagctgatttgcggtatcgccgactttaactttcacgcgtttggccttcccgtcttttaccgtaaagacccagtgctcatctccgtcttttttgaccgcggaggacggcagcgtatcggctttccgtttgtctgtttcaatgttcataattaatttaaaccccggcttgccctccggaaggtttccgatcagcttaacctggaacggatactgcacggcctgttccgtactttcccccgaagcagcgcttgacttttgatcaggaacgagtccgacagccgccactctccctttccacgttttacctgggatggcgtctgaggtaattgtaacgctttgtccctttttcactttcagcgtgtcgtattcggacaaattgccggcaacgatcaggtgttccgggtctcctatatgtataaccggttcttgaatatccgattttttagaagccgcttcttgatttaccgagattaccgtcccgtccatctcactcttaacattgagattcgccacctgattttcaagagactgcttttgcaaatcagattgctttaattcgatttccgccgttttttgctgaagctgcagatcagtccgttcggattcaatttgttttttggcttccgcttctcccacttgttttgccagatcttgttccttgctgtttaatgctctgagtttttcttcaacttgttcgatttgcatccgttttgattgttctgtcaactcattttgttctttatcaagattgagctgctcatttgtatacgtgactaacgacgaccctttttttactttgtcgccttcttttactttcactttatcaagagttcctttatccgcttcataaaaaacatactgttctttagagaatttaagtgttcccggaaccataaccgtagaggagatttctctgttttccatggttccggtttcgatttttttcccggcgctgccgcccgcgggagcggcagacttataaatattgataccgatgaatactgcaacaattacggcgatgccgattccgatccaaatttttttcatgttatacacctgctgtcactgaacttaacagtcctccgactgccgaaactaaaagcataataacaaacaggacaatcgcggaagtccaggccgcttttttcgaaatgccgcctgtatagcgaagtcccaaagcgagcagaatatagctccagatgctgaaaatgtcgaacgcgcttaaaaagaccgcgacgccgcctccggccggtatgacactcgccaaagatgtaacggcatacaatgagcccgcaccggtaaaataagtgacaagaccgttaataactaagccgatattggtaataaatgccgtaaacaggctgagtgagagcatttttttgtaagttgttacgccgcctgaaattttaacgcacagccagtaaatgagcggaacgataaacagagcgataatgcccccgaagattcctccgaacatcgagccgaatttagcaatggttttggtcatttcaatctgatcatccgacaatccgtcaagagatgagctgttcagcacttcttcataattcatccccaatccgcgcaaaatactgccggccgcgatgagaatgatgacaatcaggagaggaatgccgatgaccggcttctcttttaatcttttaaactgcacaacaggacttgtaatgacgccgaaaattgacggcttttccgttactgccgtattgcttttttccaggtttggttccatattgctgatgcctcctatgtattattctgtttatacgtacgctttaggctgagagaagtttcaatttttttgccgtttgcgtatttatgctaaattgtaacacaaattctcagctttacgttccataattatgtaaaaaaaagcattgtcagaccggtatgacgggaggttcaaagccttgtgaaggcactgtcttcagcctattcatgcagtcaaaaccagctcaatcgcaaatccctttaaatcccatttagatattctctggaattcagcgcctatatacaaaaaagccggatggcaatgatgcacatccggctcttttttcaccctccgcttacaggagggataaaggcaatggtatcaccttctgttacgatgctgttgtcttttacatatgtttcattgattgcgatcatggcattgtcaatcgtctgaaggccgtaccgttcctttagcagcgtttttacagcagacgccgccgtctctttttcgtcaagttcaatgaccggtgttcccgcctgctccgcaagcccggcaaacaataatactttaatcatcgcgattcccctttatgcaaatccggttttccgttcggatagggcgttgtttccagctgatcgcctatccattcttctccgtcttcccagatttcttttttccatatcggcacaatctgttttatccgttcaattgcatattcattcgcctcatatgccgcctttctgtgcggagaagacacggcgattacgaccgctgcttctccgatatcaaggacgccgacacggtgagtgattgcagcttcggctccttcccatttcgcactgatttcatcgccgatttgagaaagcatttgaacagccatcggttcatacgcttcatattcgagacgcaccgtccgccgtccggcagtccactctctgaccgtgccgataaacgttgtgatggcgccggcttcacgcttttcaactttttttacgatattttccgcaatgataggttcccttgtaatttgaaaacgttccatttatgcagattcccctttcagctgcgaaagcacaaacatcatggcagccggatcgtccgcatggaaaacgggcatgcctgcatctgccggcatatgctccgtatttctgctgataaccgcgatcacgcgctccaaatgcttcagcttttgccaatcttcgctgtctttgatcataatgattttcggatgcggcgcatgtttaaatccctctatgagaagaccgtcaattcccaggcattcatacagactgatcaaacccgccagatcccatttttttcgcgccgtaagctgcaggacgccatccccttctactcccgtaaccgcggccccggcttttgaaaaacgctccgagtcttttccgtcagaaaaaggttccggttctccgccatgtccgtgatgttttaaacatccaatatcgcactctttcggcgccgctttcagcacacgttcaataaacgttgttttaccgctgttttgaaaacctacgatctggacgatcgggaaagaattgaccacggccattcacttccattctcatcacggatgaggagcgcgtgaaccgtccggcccgcttcataccccctcgttcctcccggcagaaggataaacgcgtttgcttcggccagagatgtgactgagcttgatttgtcgagaccgaccggtgacgccatcatctttccgtccttatgataaacaaatgccctcacaaatctcgtaaacggattcggtttcggaaagtcgtttgttaacacggcttccgcccatccggaatgaggtttttcattcagaagccacgtctgaatcatcggtttgacaaacagggtgaatccgacataacatgcggacggattgcctgaaaggccgaacagcagcatgtcatcggcccgggcgacagttgtcacgctccccgggcgcattgccactttgttaaaaagaacttccgctccgagcttattataaatgtctggaagaaaatcaaaatcgccgactgacacgccgccggtcgtgatcagaaaatcaacttttttcatagcttccttcaccgcatcatagctgtcatcaaaatcatcggaaattttccctaagttcagcggcaccgcgcccgcttcaatgacctgggcatacaccatcgcagcgttgctgttgcggattttccccggctcaagcggatcgctgacatgaagaagctcggttcccgttgcgataatgccgacaaccggctttctgaccacgggaacggaagcatagccgaaggttgctaaaagagcggttacgcccggcgtgattttcgtccctttttttaatagcgggctgccctttttcgcatcttctccttgatatgaaatattatcgcccgcatgaaaagggcgtttcactgacatgtaattcgtcccgttttcagaaaacgtttttgtcagctcaagcatcactacggcatccgcgccttttggaatctgcgcccccgtcataatgcggaccgcttcataagggccgagttctttttccgatacggcgccggctccgatatggtcaatgacttcaaaggtgacggcattgtcacgggaagccgtttttgaatcgctcgccctgatggcaaacccgtcatacggggaacggttaaaggccggcacatcatgatccgccttaacatcctccgccaaatagcggtggagactgtcctcaagcgccacccattcggtatccccctgttttttataccggctcacccggcggactgcttcgtccacctgaatcggcgttcttttttcaagcatagcaatatctccccttcctacagtccgatcaccctggccagaactgaatttgcttcttttatatcgtttgtaccgtgaatcaaagcccgtccgtcctgaaaaataacgattctgaagcgctcatacgccatgtgcagcagaaattcatttgcttccactttaccgatctgcttcagacgtttgacaagctcttctttatccagcctctttaaggcttccgatctgatttgaacggtgtctcttccgcacagcacgcttgctttcggcctgttttcaggctgcagatacggatatacgggctccgcgccgcaggaagggcaatgatcccgtttgatctgatccacatttatgctcatattggtgttattccacacgtcaaacgtgaaaaagcgccgatttaccgccgcatgatttcctgtcagcaatttcagcgcctcagcctgctgataagcggagacgatatgaaccgccggaggtatgatgcctgctgtatcacatgtcgctccgcccacgggcatttgctcaaacaggcaggataaacacggcgtaacccccggaataatcgtcatgcacattccctgactgctgacacaggcaccgtaaatccaaggtgttttcgttttcagcgccagatcattgatgaccattctcgtttcaaaattatctgtcgcatccacgatgcaatccgcttgttcgatcagcggttcgagcgtttccgccgtaccttccgccgcgtaagcatcgatatgtatatcactgtttaccgccaaaagacgcgccttggccgccattgctttcggcaggcgctgtctcgcgtcttcttctgtatacagctgctgtctttgtaaattgctccattccacataatcccggtcaataatcgccatacggcccgctccggctcttgccaggccctctgccgcggctgttccgagggctccggctccgacaatcaggacactgctgtcagccagcgcctgctgccctttttcccctatcggcttaaatcttgtctgccgcgaatagcgctcttccatctgtgttgtccccttgcatttttatttccatcataccatgtttcttcccgatcagtcctgatttgaagactcgacatgcgccaaaagtctggtgtaatcgtcccgtgtgttgatattagcgaactcctccggcccggcgccgatgtcttcagcctgcacataacagacagacagccgtttcaacgtgtctgtcattttcagtttgttttgtgtcagctgatcaaaaagcacatcctgcacccgtttatggtaaaccgccaagaggggctgctctctgttttcacaaaccggtatgacagcatccaggtttccggtcagcttcttttcaagcgcagccatcgtctttcttgtcacgagcggcgtgtcacaggatatgaccgtatatgtttcgccttccgtttgttccattgccgtatatatgccggcaagcgggcccattccccgaaaccgcggctcatcggcaaaaacatgccgctccctgtttgataagaacttttttatatgctcagggcggctgataatcaccgtttctccgccgccgaaggcttttttcgcctgttcataaaacatgccgcccttccactttgcaaaagctttcggttctccgaatcttcgggaagctccccccgctaatattacattcacccgtttcatgtcatctctctcccattctatataaaagcatagcaaacgcctcagccgaaatacaatattacggtgcttgtctgtttaattaagaggaatagccgttgttcctttcccatattgtagtgttaacatcatgagggagatggttcttatgaaaatatcaggtccgtttttccacgacacttctcaagagaacctttacttgaaatctgaactttccagatgcagaaaattaatttcagaatttgaagcaagctacttccatcagaaaaataataagcttcaggaggaaaacgccaatattaaagagcggcttcacaagctttctgacgaattggaagccatggctcaaaaacacaaacagacaagtgacacggaacgttctttgcatgaaatcagagccgggctgctcgataaaatcgtcattctgcaagaactgcttcagcaggaaacgtttcggcggaaaaatgagatggaagaaaagcaccgtctgcatcttacaaatgtaaaatttgaagaagaaaataaaaacttacatacccgcatccgctcacttgagaccgccattcaaactgaacggacttctcacgaagatatgaaacagcgttatcatgccgctgcagacgaaaatacccggcttcaaacacaaatgatagaaaaagaataccagctcaaacatattaaaatagaaattaatcatatgagagatcgaatactagaaacaaaagaacggcttgtagaaatagaaaaaacgaaagaaaagttatttcaagaaaccattctttcatataaacggcagctggacgaaagtgatgcttggattgccggccattttgctgatattgacagccgcacggcggaaccggcggaacaagctctggaaatcccttctgtttccaaagagactgttcaggcagaagacttgcttaaagccgttaccgaacaagtcatctccctgcaaaaacaatttgtacaatcagagtcccgcgatcagtcgtttgatgaaaaactggatgcgttgaaagaacgtgctgacggcgaaaagcctttccaaaaatatgtcgtcaagcttgaaaaaaaacctggaaaagatgcgtcacttccgcagaataagcgggaaagcgcaaaaaaactgcttgagtaacgcaagcagtttttactgttttattcagcagccgtatcatttgccgtttctgctgtttcctgagaaatttctccctcaagaatatattggccacggtatggttttttcacttccggatacattttaattaagctttgcataaatgttgtcatattaggaatttcaaggccgctttccttttcaatttccttttgcagttcggaacttttaatcgctgcattgtggcgtttcaatgttttaatcgctgcttcgcgcagttttgccgcttttgatcccggtctcgccgtccctcttcttcttcttgtagaaccgtctggaatgccggcgggaagagacgtaatagactgcatctgcggctgggaggattgaggctgtgtctgcggcttttgatagcttctcatttcctgtgctgcaagctctgcaagcaccgggagagagtcactttttttctccggacgaaactctttttttgtatcggacaggctgcctgtattgtctaattctctcagttttgcatatattttatcacgttctatttgatattcacgaatgacttttacctctgcttcgttcaattgttctaaacgtaagcgcagcgcttctctttcattaaacatgtgtaaaaccccctgtcaaaaatttaaacgcttttattaagatattagattacaaaagtaattttatcaactattattttatcattttactattttatttactctatgaaaaattgcttattttctgaaaatggtactttatatacaaaaatcccttatcatataggggattctggacaaagttccaatttattcaaccatttcaaaatataacttgaaattacttgtttaatgaaaattagcgtgatatctacaattttcgactataatatgtaaaagataatgatatcgataaaacaagcggtacagcgtgtttacggctgtttctcttattttttaagcacacatgccatattggaattttttatcaaataagcacaaaaaaaccctgttacctaaacggcaaagggtttgcagaaccgagacaatagtccgacggagattgtcccgattactcagaagcctgctccgtttctgaaagtactcggctgacacgtttttcaagcattttcatcccgcttcctcccgcttgaaaatggcggagctgtccggttttatcgaaaaggtaataagccggcacatattcattttcaaatgcttcagtcagcgtatgatcgctgtcgacgtaaatcggctgagagatatcgtgttcagccgctgttttcttgattttctcaagatcaagatcgtcttcggaacggggcatgtgaacggccaccacattcagctgatctttatatttatcacgaaattcgttcatctcaggcatcgcttctttacacatgcggcagctggcggaccagaagtgaatcagtgccggctttccgccgaccagctgttccttcgtgacttctctgttaatccatgctttagcgcctgtcaattcaggcatttgctgacgtaatttcatcttatttccctccttatgaaaaaggttttttgccggggctttcagtttcgccgggcaacgttctcctgttttccctccaaaggatatgatttggctgaatcaccatgttaaaatgagtgtggcgattccttagttcatatcttcacaaaaatgatgatattgaaaccgtgcaatatgaacaaatcataaatgaaataactggtttctattaaaaggtttatcttattttaaaaacgggtatatcacttttagctttttccgcaaaagacttgaaaggaagacatcactatgattgatttaaaacactttgactgggccgggcttctcacatctgccgggattttcatcataaagctggctctcattattttagcgtactttattttccggacggcaggaaaaaagctgatcaagcatctgtttcagaaattcgagcaacaaaacaacctctccacaggccgcgcttatactttgcgaagcctcgcgcttaatgtatatggatacatcttgattttcgtttttatcgtgatgattttggatttatttcactacaatccgagcgctctcattgccggcgccggcgtggtcggtctcgcagtcggcttcggggctcaggggcttgtcagtgacatcgtcaccggattttttatccttttggaaaaacagatcgacgtcggcgattatattacggttgccggctacagcggcattgtcgagcaggtcggtctccgtacgacgcaaatccggagctttgacggcacgcttcactatcttcccaaccggggcattacgaatgtgagcaaccattcccgcggaacgatgcaggcgcttgtcgatattaaagtgccgcttgaaaaaaatcttgatgaaaccattcaaatcctgcaaaccgcgtgtgacaaagcagccgctgagctcccgcagattaaggaagggccggacgtcatcggggttcaggatttaagcacgtcagaaatggtgatcagaatcattgccaaaacagaaaatatggagcaatggcggattgaacgcgtactgcggagagaaataaaaatcgcgctcgaccgttttaaaaacgccgcttccgccgaatagaaaaaccgaagcgtaagcttcggttttttctttttaatgaaattttttttccacttcgctgcagatttcgtcggcggtcattccggaagccgtaatgacgggagcctgagttgacgtatcggcaattccttggacattgctgtcaagtccggttacgacacagcagtcacaattcttcgcatcctcaggagtcttcatcatcactacgtcatatcctttttgttttaacgcctgttctacatccgataaagattgttcaattccaatttttttcgtcatattgaacacctccgttatgtagaatgctcaattattgttagattattcttcttttcggatttaattggcatacttcgaaaaatatccgaccatgacatttaccgcggtttccatcgcatcttcatccgggttcagcttggcgtgatgaagcccgtgggatgaatcggcccccagccagaacataaagccgggatattttttcagcatatagccgaaatcttctccggtcatcgcttctttcgccgttctcacgtcagcaagctgatgatcgctgacaaattgcataaattcttcggtcaggccgcttgtattataaacttgatgataaacggacggatacgtgacttttcctttgcatcggaagccgatttcaattcctttgacaagctcttcaatccgctttttcaccatacgcattgattcctcggaaagcgtccggatggttccctccagatgagcatgctctgcgatgatattttgcgccgtgcccccggtaatcgttccgacagttatcacagcgctgtcaagcggatccgtatttctggatatgaccgtttgcagctgcgtgacaagcgtgctcgcggcaacgaccatgtcgtctgctgtatgcggatatgccgcatgcccgcctttcccctcaagatcgatgacaagctcgctcgtattggcaaacagcaatccgcttttggtggaaattgtacctacaggaagctcaggtgctatatggagagcggtaatcaaatccggcgtccattttttcagcacatcgctttcaagcatcggttccgctccgcccggtccttcttcagccggttggaataaaaagagcagatcatgtttgacgggatgatggacaaaatgatcaataatgccgagcgcaatggtcatgtgcatatcgtggccgcatgcgtgcataaaaccggggtgttcagatacaaacggaagccccgtctgctcttcaatcgacagagcgtctatatccgctctgtaggcgagcattttttccggagccgtgccgttgactttgacaaagatgccggttctccaagtttcgatttcaattctttcctccggatattggttcaatagattcagcaggtactgttgggttttatattcctgaaagccgatctccggaatgcggtgcagatctcttcggatggcaatgagccgctctttttccatatgtattcctccttgagataagaataaggcgtggattttatcatccacgcccattctatcaaaccattccttacagctggcgtaattcctgtttgatttctgttttgccttttgttttttcatcgatatctttgatttttttcgcaggtgttcccgctacaacggtatatggctcgacgtcatttacaacgatggctccggcagcgacaaccgcgcctttaccgattgttacgccttcaagcacaaccgcatttgcgccgatcacaacgtcgtcttccacgacaacaggcttagcgctaggcggctcaataacgcccgctaatacagaacccgctccgatgtggcagtttttgccgacagtcgcgcgtccaccgagaacaacgttcatatcaatcatcgtaccttcgccgatgactgaaccgatattaatagatgcacccatcatgataacggcattgtcgccgatttcgacttggtcgcggataatagcgccgggctcgattctcgctttaacatcttttaaatcaagcatcgggatcgcagagttgcggcggtcattttcaatgacgtaatcctcaattttgtctttgttttcttcgattacgcttttaatttcagcccactcgccaaaaacgacgccggattggccgttcaggaatgttttagcggaatcgccaaagctgattccttcaagatcgccttttacatacacttttacaggcgttgattttgtactattttgaataaatgaaataatttcatttgcatccatcattttcatatgtattgtcctcctctgattttctacctcattactgtaacaaaggaaggatacaaagacaagaaaaaaaggaacaagcctttattctgccggctggctgcacagcgcggcaaactgtcttccgaattcccggagctcttcttcctcactgccctcagggttgttttcaattttgaccgacggcagcaccacccgcccgccgcgggttttgattactttttccaattcgtcaaccgccccgcaaaaaaactcataggacgtatctccggaaccgaacaaagcaaatgtttttcccgtaaactccaggttttccatatcttcagcaatatcgagcatttcatcaggaagatccccgtctccccacgtatatgtgcctaataaaatatactcgtaatcattaaaaagttcggcatgaatatccatcgcttcatatctgtctacggatgcttgtgcttcgatcagccctttttcaattaaatccgccatcgcctcggtgtttcctgacattgtggcgtaaacaagcaatacattccccatcttcgtctctcctttatgcataaaaactaatgtgcgagccgaaccgcctcatacggtctgacaaacttactttcgtaaaggcccgcgcaaaaaaagttttcttcccggttggccacccgccatccgtgaccgcggatcgtatcaaaccactttaattcaccggcggcgagatcagcttgataaatacgcgaaaatccgttttcgtcctgtgacgatgtgacataaataatcccgttatcctcagaaacgtcgagaaatgatttttcccgtacggcgggtccggctgtaatggcaaactcctcttgcgtccgcacgtttcggacggcaacctccccccgttctccctttgccgcgccctttgctgcaatgagccagtcattctgatacatcatcattgaagccgtcatgcgctgcctttcgcggcttatacgccggatgcgttcttccgtcagatcatacgcccaaatgccgccatgattcatatgaatccgggtgccgatataaatcgtctgaccgtgtaaacaaagcgaacggatgacaggcggctcctttaattgtgaaaagggcttagccacatgccaagtgacgccgaaatcatcagataagtagaggcagtatgtgccgtgcgcacagacaaacccgtcattccgcccggcaacggcccatacggaggcgctggtcggaaaacgggaggccgtccaagtctttccctgatcggctgatctgaggacggcgcctttttctccagccgcgaatatgtagggccctatgtaagtcagcacatgaattctgcttttcactcggaacaatcttttccagccttcttccgcggaaaaatgaaaaataccttcgcctttcacagccacaaaaaatcccgaagatactgatgccatgacagccgtcgcgcctttatgaaacatagcaccggtctccgtggtgtgcggcccatgcaagaaaaccgcggacaaattctttgcagcattcctgatcctcagccgtctcgggcgccagctcgattttcagcgtttccggatataaattggctccggcctgttcaaacgcatcgcaaaacagcgtgaccgcttcgcaaaacttcgggtaggcgtgatcgcctgaaccgaaacaggccgttttcagtccgttgagctggctgtgcagaatatcttcgtaaaaatcttccgcttcgtaaggaagatcaccgtccccccatgtatacgtgccgacaaaaacataatcatatgcttcgagagaatccgcatctgcttcgtccatgtcaagacagtcaactgctatctgatgcccgctcagtgtttcttttataatgccggcaatatcctctgtattccccgacatgcttgcgtatatcattaatgctttttgcatatgatcacctcgtaattgataatgattttcattaacatatataacactttaaatgataatgattttcattgtcaataaaaaataaaaaaaagacagcatgattgctgtctttctaaaatgggcgttcctgcttcagcatatctttaatgacagaaacaaaagcctgcacctgttttaattcaaatgccggctcatatccgagcagccatgtgtcacggccgatcggatggtcctttgtatcaagcaggggcattttatttactttatcttcctcttctaaggtgactgacggcagaatggcataaccgatcccgtgcagcgccatctgcttgcacgtttcaatctgatcgacaaggatggtctgtttcggcgaggttttgaatttttgatgccaccaatgctgaatttcctgaaaatatgtactgtcacttttgaattggatgaacggccggtcggtatgggcaatatcatcaatacaggaaatttccgtatcgaccaaatataaatgatcggtcattaaataatctttccggcctttccattccggatttccccggataatgccgatatgtacctgatcttcatacagacttttcagcatttcgctgctccaccctgtaatgagagagacctttgcattcggatatcgttccacatatgtttttaacactttcggaagccagtgctgcccgataatcgaagcgacggcaagctttaatgtgccgtgaatctcaccctcaagttcatcaatgttttctctgattctttcttgccgatccgtgacgtcatttgcaaattgtatgattttttctcctgccggcgttaccgtaagtcctttttgagacctaagaaagatctttgttccccaggctttttcaatggtctgcaatcgctgggacagagccggctgtgacacgaataaccgttcggcagccttcctcatgtttaattcctcagctaaaactacgagcatatgaagctcttgaagctgcatgttgtcctccttttcaatgccttttcgtatttcttatctaccattctaataaaataaaggctgccgaggcaagcgccactcatatgtatgcgttttctttttctggcatgcaaaagaacaaataggctgatcgtgcgagcctacttattcaatgatctgatatggctgctcaactgctttaatacgactcttctcgtgaaaatgccttcaaagacgccttcatcattttcaacgcagacaaagccgttgttaatgaccatgctgaaccctttgataatcggatcattgatgtggagacggggaatgtctttcagcatgacttcctcaaccgtaatttgatccagcttctcaaactcgatccgttcaagtccgaaaatgctgttcataatcatatttgtcccgatcaaaccgtgcagacggtacgaagcgtcaaggacgggaatggcggtatagccggttttcgtcagcactaatagagcatgttcaaggttgtttccgacttgaacgtgcgccactttatccgcctcgatcataaattgtccgactgttgcatcaagaagctgatctgattgtaagctaatcatgtcacttcgacccctttacatttttcatcaaagcatgtattccctatattgcaataatataaacattatcattttttgtcgaaaagtttccgtcaataaaaaagatactctttgcaatcgagtatcaatttataggccgctgattaattttcgttccgaaaacggtcatagagcgttacgagttttttataagtggttccatcaacgctttttgaccctgcttctatatcattgatttcgctggtcaaaagctcaatggcatattcttgattgatcaggatattcagcagaagtttctgttcttcttccgtaaatcgttcactgataagactcatacgtaatcaggccccctatttttaactgaatacctctgaaagcaatgtgaaatttgctttcagctctaccgctagaataagtaaacagaaaaaaatcgtcaaccgcataattcgacattttgcggattctgtatgaaatattattttgtgtaacgattggcataactgaatgctgtgcaggaatcgggcttgattttcgcttcaatgcccatcgaggtaatgcggccggtcatttcttgtatcaattcttttgtcagtcctttttgaccgatatccagatgcacttcaaatgaaagatccgccccttcatccgtaaaaggcaagagcaaatctgtcagttccataagacggtcgtcgaggatatgcgcagccatctcctggctgaacgcggtttccagcgaaattttttcgcgaaggctatgtatcggtcttgcaagatcatgatttttcaaacagccccaagctcccttgcctgtacggtgcaagtgtatagctgtaataaactttgtgaagtcgcggtaaacttgtgaatcagtccctacagacagcacgtatgctgaacgggggtctttattgacaaagcgtttcagccgctccgtcacgtcttgaaaggtcatctgtgcctcagaaagattataaaacagaaaagaatcagccatgtacggacactcctctttccagagtctacaaccaaacgaacaagcacgttcctttgcataatttaataaagctccgcttgcggaagaccggaagcttggtcagcctgaaaaatcaaatcaaattactgaaggagctcaaaaatttcaatagaaatcatgtcaatgttatcaaacggatatgtgttaggtttttcacctttttggaaaaccgtcagttcaaacgtttgatttttttcgaaatatttaacactgcaaattttttcgccgttaacttcaaaataacgctgcatcggctcgttagccgcttccgctgtttcttgcagactttgcagccgcgtgatgatacccattaattgtgacattctaaaaaaagactcctttcaaaaaacaacttcaaatcaacaagtatttattataatacaagttctacagagcatcataccataaagtagaccgggatggcattttcccgctggattttcaaaaagaaataaacgggaaaaccgtgttttcgaatagtttgaagcttttttcggaatgtcatacacctttcaaaaataatttttcgctttttgagccgccattatcagatgtatgtaaggagaagcctttttatgcgagacggcataaaaaaacttggcgggggtagcgccaagttttttcggatcttgatctgatagaggggttggggaacagagagtaacttctctctataactaaatgataatgattatcagtatcattgtcaatcgttttttaaaacttttttcaaatgaacaaaaaaagcggcatacagcagccgctttaaagtaacccgtcctgttcatataaataagagtaaggcagatcgataaataaatacatattgtcatccatcgggtatgaaaaggttctgatcatctcacctgtctcaatatcactgtacaggtcactgaaaaagccttttcttgaattccgcatcttcatgatgttttctaaaaagtacggacgccagctccagtttttctccatgtattcaggctgataaagccattcgccggactgcttgaacacatttcccgtcagctgatagccttcttcatcacacatataaattctgaagcagcagtcggtcaggttttccgccagttttttaataaactcatcgtccgcctgatgggttttctttagctcggaaactgcctgattgacccgcttataaaaattctcagagtgttcatataccgtttccagcttctttttttctctcgtaataaattgctgaaactccgttttcaagcgtgcttttaacaggctccggtctataaaatccccgctcggcgcctgcagataatagccttgaaaaaatcggcctccgtttctccatgcgtactggagctggaaatcagcttctatatcttcatacagcagcgcggcgccgatttttctcgccagcaatgaaatgctgtacagcacatgctcatatgatggtgacggctgagataccttcagcgcctgcaaatctattttcagaaggtccggtgaaaggagcgcgattctgtccaggttgctgctctccttacctatattgtccaccgcgattttaatgccgtatgtacgatagtaggcaagcatatggtacagctgttcaatgtcgccttcgaaattgtgctcggtgatctcaagcacaatacggttcaattcaatgccctgctcttcgtattctttcaaaagctcaagaaagctttcgccgtggtcaagcatcaatacattcgcatcctgattgataaaaatcaacagatcacggtcagcttctttaaaccgctccagcgcctgcctgatgactctgtcatcgacctcaagcttatattcttccggaatgccggaatctaagaaaaacggcccgaggctctcaatctccgcatctgccaaaatccgcccaagcacttcgtagcctacgactctttgttcctcagcgttaaaaatcgcttggtaatacggaatgacatcatcaatattcgtcagtatatcaagtgggtccaacatgttatcacctgcttctctatctttgtctgattatacacaattatatcagcaccacaaatgtttagattaggggaaaaggaggcagtatggccgcagcttaaaataaaagggggacatttttaagatcactcttcagaccggttaattaaggacgttattcatttgtttcacaatcacaaataaaaggataaatataagagcattataaccggcagctgtccaaaaataatggctccaatcagtgctgttaaatatccaatcatcatcatgtttcaactgaaagaaagttccttttttatctaaagtgccaaatgtaagagttgttaacccgccaacactctcggaaacgtcaactccatacattgaaccggcagtatcagtatgatttattggcatatacgtgtaatcagataaaattgtttccgccagcttggctggcagagacacatataatacagccgatgtatcgcctccgagcccactcaaatactccctggctttaataaatttcgtttcatcaggaaaatcgatgtgatatagcttttcaaatctgattatttcatcagatgtaagattggtattttgataatactccggagtaaaagcacaaataataaagtaccaaatattaaagatgataacgaaactgcttacaaatagtacaacgaaccattttaataatttcttcaattaatcgccccttaatctttcaaaattatatcataattttgaatagaaaataaaacaagcgaacggcggctttaacgttcgcttgttttgcaaaataatcaatatatgaaaaattaaaacggataaggattcagccattgacccccgtccattgtgatacaatccccgtttatataggacgcttcatcagatagcaaaaacgctgccaacgcggcgatttcttccggtgtgcccagccggccgagcggcacactgttcatagtgcgggacaccgctttttccgattcaaacagcttctccgcaccgcctgtccgttcaatcgggccgggggctatcgcgtttgtgcggatgccgtatttgctcccccattcaacggccagcgttcttgtcagtgacaatacccccgctttggctgcagcggaatgaacgacacccgctcccgctccccatgcgtatgtagcggccatatttaagatgacgcccttctgctcctgctcgatccaatgccttgccgctgcttggctgcagaaaaatgtgccgtttaaaacaatctcaataacagctttccatccattgggcgtcagcttctctgccgggcaaataaagttgccggccgcattgttaatcagcgcatcgagccggccaaagacttttttcgcttctgtcatcatgtctgaagcggcggaatcagaacggacatccatttgaaaacaggcgacctgcccctcaaaggtctcaatttctttttttgtttcctcaagtgcttcatggttcctccctgtcaccatgacgtgccatcctaattcagcctgttttttcgccattgcttttcccatgccgcttgatccgcctgtaatgattaccgctttcttatccataacaaacccaccccttattattgaatgaataatcattcataattttatcacagatgtctttccgcgtcattacatgctgagaagggatttttcagccaagctgatgatataatagaacaactctgacaaaggttggttttacatatggagaaaatgaccagaagaacatttttaaaaagaggattcggcattttgggtacagctctcgcaatggcttgcggaggttacggctatgcccggtatattgaaccgcgcatgattgagatcacccggcatacaatcaccagccgcctgatcccccgcggttttgacaattttaaaatcgttcaattcagcgatacgcatctcagtgatgtgtttacatccggtgacttgaataaagcagcggaaaagatcaatcagctgaaacccgatctgctcatctttacgggagatttaattgataagccgcatttatttaatgatcaccagcatgcactcgccgtgctgcaaaatcttgaagctcccttcggcaaactttgtgtttacggaaaccatgaccacggaggctacggtacgaacacgtacaaggctctgatggaagcggctgattttcaagtgcttcgaaacggctaccgtcaggtgcagctgacagatggaagccggattgaattcgcgtttttggatgatgtaatgctcggaaaacccgattatgaaggcaccctgtcacgcctttccgaagatgcgttttccattttaatcgtccacgagcctgatgccgctctcaagataggcggatatcccgtaaacctccagctgtcgggacacactcacggcggccaggtccagctcccgtttttcggccctcttattacgcctccttacggaaaaacgtataccgacggcatgtatacgctgcatgacacaggcgtttacgtcaatcgcgggctcggtacgacaagactgccgtatcgatttttagccagaccggaaatcacgctgttcacattgaaaaccgagcaaaaataagacttttatcctgatgcacagacaccccctccgtaatatgtatatggaaaagagcaaaaaggagggtgatgaaactgctgacatatcaagtgaaacaaggagaaaccatctcaagcattgcgcaagacttcagaataagcactgctgctctccttcaggcaaatccctcaatccaatcggtcatatacgcgggacagcatattatcataccgaatcttcccgacccatccaccattccctactccatcatcgtgtatatcggagcgaagaaactggagttataccgccttggcaggctcatccgtacgtatcccatcgcagtcggaaaaatattgacgaccacgccgaccggagaattttacatcgtgaaccgccagcctaagcccggcggcccgttcggcgcttattggctcagcctctctaaaattcattacggcattcacggaacaaataatccttcctccatcggcaaagcggtatcaaaaggatgcatccggatgtataatcaggacgtcactgaacttgccgctgccgttcctaatggaacaagggtgactattataagatagaaagatcttatttgttaatggaacgagctgatgataatatattacagtgggacctttagggtaaggagcgtgtttatggatatatttaaaaatcgcaattttgtccgtctctttttcgcagcactcgcttctcaaatgggaacgactgtaggtaatatggctttcgctttttacttgctggaccatttttcaaaccagccggcatacacgactttggctgagctgatgtattcactgccgacagttttcgtatttctgattgtcggtgtcgcagctgaccggcttgataggaaaaaggtcgcagagaattgtgactggatcagagccggactgacgatcgtattgtttgccgcattatacaccgggagcatccctctcgtgttctgtattttgttcatcagaagcgccgtgaccaagttctttttcccggcggaagccagccttgtacaagctattctgcctaaggagcattacgcgaaagcggcgggacttaaccagatcctgttcagcatcttcatggtattcggtgtcggtataggcgcgtttatgtataaaacgatcggtattcacggagccattatccttgattttgtcagctttattgtatcaggctttctgatccgcgcgtgccgcattccgaaagaagcccgtcagccgaacggcccttttaaatggggagattcgtttctgaaagactcggtcgctgattttaaggaagggatcgtatatattgttaaaaacaaattgcttgcttcccttattttcggcttttttatctttggttttgtcaacggcggctttgccgtactgccgatgtttacgatgaaatacggactggcgcctgatcattacgaatcacatacttccatcttcaccgtcgcactcggcttcggcctgcttgcaggaagtgtgatcggaacgatgatcgcaaaaaaagtcaaaccgcatcatttgatgtcgattcctattttggcagccggactgctcatttttatcctcggctatacggataagctgtggatttattatgcggcggctttcgtcctcggcatgtgcatcggccctgtcaatatcgccatcggcggctggatgccgaaaatcgttcatccgaaaataatgggccgggtcagcggctggcaggatccttttatgatgtttgcccaatcgattacactcggactggtcgccctgttatttccgaaattcgttaccaatattgattacctttattacggcatgggaatcgtgattttagcggtatttgtgttctattttatcgctcttccgaaatacagcgccgaggcagcagagatcgatgtgcagcaatcattaaaggctgattctgaaaaacatgcgaaacctgtctaataaaggaaaaagatgcgcccttttcatcagaaaaaggcgtatttttataatcaatatttgcatttcaacgctaaaaaagtataatctatatatgaacttgatcaatgcaaaggagagaaataatggacgaccacgcttattcgaaagagctgcagccaaccatcgagaatctttcaaaagctgtttatactgtgaaccgccatgcaaaaaccgcccccaaccctaaatacctttatctgctgaaaaaacgggcattacaaaagcttgtgaaagaaggcaaagggaaaaaaatagggcttcacttttcaaataatcccaggtttagccaacagcagtcagacgtacttatctctatcggagactactattttcacatgcctccaacaaaagaagacttccagcatcttccgcatttaggtacgttaaatcagtcgtaccgcaatcctaaagcacaaatgtctttgacaaaagcgaaaaacgtattgcaaaaatatgtgggcttaaaggaaaaaccgcttgccgccaacaggcagcagcccgcttatcataaacccgtatttaaaaaacttggtgagagttatttttaattccgccgcaaaaaagccgatgcgtcatgcatcggcttttttctattcaatcacgtacgtatccacttttttaatgagctcgctgatttcaggcttgctgatctgttcatccgctccgacgacttcgccccggtggcgcaggtcgtccgtaatcagggacgagaaaatcataatcggcacatcagagctttgcgggttatccttaaggagcttcgtcaaacgatgcccgtccattttcggcatctcaatgtcactgataatcatgtcaatatggtctgacaggtttgctccgttatccgtcagttccacgacgtaatcatacgcttcttttccgttttcaaacgtaacgatttcactgtaccccgcctcagtcagctcatccgtcaaaagacgcatcagaagcggagaatcttcaacgatgatcagttttttacccgcccgtctttcatcaaatccttcctgatggacatgataagtctcaactccggatgccgattcaatatcataaatgatcttttcataatcaggcagaaagatcatcgtgtcttccagtttgatgattcccgttaaatgccgctccatgccctggttcaaggaagtcggcttttcaatcgcctcccaggacaccctgtggatttgtgaaacggaaccgacgtgaaagacgattttccgcttgttgaattccgttacgatatatttatcgtcttttgctccttcggcatcaacgccgaaaaaggtatacagactgatgacgggaagaatttcgcctctcagcttaatcatcccttctacgtctttatgagactgaggcacagatgtgacatctaccggctgaatgatttcccggactttcatcacatttatgccaaatgtattgacgcctacttcaaatttgacgatttctaattcgtttgtgcctgaatccaataaaatatcgtattgttgtaaagacaattcaatccctcgctatccgcattcagtattgtactgtatatatcggctgtaaacggaaaaagtgaatgtattcgatccaactggccatgaactctttataaaaagatgcttttttctgatatcccattgactttttgacatcgagtggtaaaatagtcaaggatttttcaggaagaagggtgtaataaatgggtacagtagtcatattcgaccaagatcaaatgacggtgttagaagatatcagcaaaacggcttacctgcaaatgaaaaaagaggcgaaagagcgtcccgacaagcccgctccatacatcttatggcgggaagacgtcagctttgaatacgggtattaatgacattcgccacatatcacaatagatagatcatgatacaatgaagacaatcatttcagctggttgtcttatttttttctgaaagaaggtatgttttcacatatcggacatatactcgggatagttcaataaaaagatgacaaatgctcagctagtggtaaaataggagaaactcaatatatagtataaggtgatgaattatggaacatttgcttaatccgaatgtaaaagaaattgaaatttcaggaattcgcaaattctcaaatcttgtagctcagcacgacaatgtcatttcgcttacgatcggccagccggatttcttcacgccgcaccatgtcaaagcggctgccaaaaaggcaatcgacgagaacgcaacggcatatactccgaatgcgggcggccttgagctgagacaggccgtacagctttatatgaagaaaaaagctgatttgaattatgaagctgaaactgaaatcatcgtcacaaccggggcaagccaagcgattgacgcgtctttgcggacgattttatctccgggcgatgaagttattctccccggaccgatatatccgggctacgaaccgatcatccgcatgtcgggcgccgttccggtccatgtggatacgacgacacacggatttaagctgacggcgcggctcattgaagaatcgctgacaccaaaaacaaaatgcgtcattcttccttatccgtcaaacccgaccggagtgacattgtctgaggaagagctgcaaaacatcgcagccgtcctgaagggcagaaatgtttttgtcctgtctgatgagatttacagcgaattaacctatgacagaccgcattattcgatcgcgtcttatttgagagaccagacgatcgtcatcaacggcctgtcaaaatcacacagcatgacgggctggagaatcggtttcattttcgcaccgaaagaaattgccaagcacatcttaaaagttcaccaatacagtgtgacatgcgcgtcttcaatctctcagaaagcggctcttgaagcggtgacaaacggtgttgatgatgcgcttattatgagagaacagtataaaaagcggcttgactatgtatatgaccgtcttgtttcaatggggcttgacgtcgtaaagccgtcaggcgcattttatatcttcccttccattaagtcattcggaatgtcatcgtttgattttagtatggctcttttagaggatgcaggtgtggctcttgtgcctggcagctcgttttcaaagttgggtgaagggtatgtgaggctgtcattcgcatattcactggatacattgagagaaggcttggaccggctggaagcatttattttaaaaacgagagaatccatgcagactatttaaacaacggcataacgccgttgttttttattgtttcgggaatgtaatatgaaaggccgtgcctctgtccggtttgctgtctacttggatagctccctggtggtttttaataaggttgaatgtgaccatcagccccaggccggttcctttttctttcgttgtcaaaaacggttcgcctattcgtttcagcacgttttccggtatcccgtcaccctcgtctttcaccgtcacattaacggaatactcatcttctgtcatgatgatgtgaaccgttcccccatccggcatcgactcaacggcatttttaatcagattgataaacacctgtttcagctgattttgatcaccgttaatatacatgctgtcatgttcgtaatccgttttgataaaaatccctttaagatttgcctgcgtctctaaaagagcggtcacttcacttataattttctttaagtttacacgctctttcacggcgttttgctgaggtttggcaagcattaaaagctcacttaaaattaattcgattctgctcagttcagaaaacacaatttcaaagtaatgttcgttttcccccatcgtcggcttcatgagctgtaaaaatcctttgatcgccgtcagcggattgcggatttcgtgagcgattcccgccgccagctgccctgcgatagacagcttctccgacttcagcattaattcctccgtctgcttccgctcagaaatgtcacgcagaatgacctgcacggccgtttctccgaaaaacgtcgtcggaatgcagaccatttccgtgtagatcagccggtttttaaaggtaaaccacgattgcttaataatttctgactcggtctttcggttgataatattttggatccgctgtttcacgccgtcatgatcacagggatgaagctgatcatagacgtttttcccgattaaatcttcatatgtttcagcctcaaacagcgaaatgcccgactcattcatgaatacccatttatcattgtgaatcacggcgatcgtatcaattgaattctgaatgaggagctgataacgctctctgcttttttgcagaatcgtttggaattttttccgtgaagaaatatcaatcagaagcagcaattccgcccgctgatttttatatgtcgtcggtgccgcctttacttctaaatgaacgggcgtgccgtcgagtcttctccacgtctgttcgatcattccgacttccattcctttttgcatccgcacaattcggtttttcacaatgtcgtgatactcttcttcaataaactcataagagcgcctgccgattacctcgtctttgctttcggctcccagcatggcaagcatcgcgttgttggcgtaggcgattgtgccgttgatgctgacatataaaggattcggcagcatttcgacaagacgctcgaattcgccgtttccagccgcatcttccgactgttgttctgccttttgcttcttttgttcatacatataaggccggcggggcgtcttctcctcaagcaccttgattttgaggatgatttcccgatccgtcccctccatttgcggtgtgacaatttccacacccgcttcaagccatacgatggtatgatcttttttaataagacgaaaggtgcaaggcatcaaatgatgctcattatagaagtaactttcaaccaaaaattgatcttcttcatgcaggaacgttttgagaaatgacccgatcatctcttcctgagaataactgaagtacgatttgcagtttgcagaaatatacataatacgcccgttagacgtcaaaacggcatgaagatcggttttcgattgaaactgtttgacatgctgagtatcctgttccacagaatccctcctttgcattatactcgcactgcaggctggacacggactgatataaaaagaaattccactagattgattcgctaaaaaatgagcattctccttctattcttattgtgaacgtcaattttcctgaatgaaagaaagggcgcacgagatgttcggccgccctttcatgtgttattttttattgtatttcttttcaagctctttgtaagcgtcaactgctcccttggcaatgtttttgcttacatgatctttatcatttcgaacagacggaacgacgacgctgaatgccactcttggatgttctgacggataatagccgacaaaggtcaggttatacgtgtacttcccccaccagtttttgttcgtgccgtaatagtgcgtctccgcggttcccgtttttccggaaacatcagcgccggaaccttggaatgttgaataagccgttccttgaggtgagcttgtgaccaatttcattcctttatgaacctgatcaaaatcgctcggactgttatttactttgttcaaaattttaatatctcgctgttcaatcgcttttccaatcttatttttgctgtccggttcatgaatgcttgtgacgatccgcggctggacgcgatacccgccgtttgcgatggctgaaatatattgagccatttgaagcggcgtatatgtatcaaattgtccgatcgcaaagtcaagcagcaatcccccgaccatttgcggatttgactgcatgcccgctgattcctgcggaagatcaatcccggtcttcacacccaggccgaattgggcgtagtagttgcgcattttcttaatatcgtctaatccggcaggcagcgtgccgtgcgggacataggtaatgcccgcgatattcatggccacatgaaacatatacacgtttgaacttctttgcagcgcggtcagctcagtaatggctcccatttgtgtccacgattgttttctcgttttgcctttaaatacaagcggtgcatcgacaaacgttttataatgcgggaggccgctttggtaacccgcgagaacagtcgctcctttaacagaagagcccatctcatattgggtcgtaaatgctccgatcgcaaaatcctgtgttttatttgtttcgagatcgatgcgtttccccgccattgagagaatatccccgttgttcgggtccatcatgacggcaaatcctctgtcaaccataaagttgcctgcggcgcggcttcttctcagctctttttcaatgactttttcgactttcgactgtaattccatatcgagcgagagctgaagatcgtagcctctgctgccttcatcgacgggcttttggctgacgacctcacctttgctgttttccacatactctactttttctttatgcgcgtttaaatagtcttcatattgatattcgatgtagctttttcccactcggtcattcagtgaatagcctcttgtgacatagtaatctttccgttcgcccaacaatccctgttccggtgtcgtcacaccgccgaacagagagtaaagcgttttgtcatacggatatttacgcgtccagtcattgatcacgtcaatgccggggagctctttcaggtgctcggatacgacggaaacttcttcatatgtcaggtcgctttttggtttttgcttgttgttttcatgctcgtcaagcagtgaaccgctgtttccgtttccgttcagcttattcgggtccattgatttgacgacttgcggctgataggcgttgccgcttgaaaaacgcgtataaatcgccgcgatttccagctcttttttattttgtttgatcgcatcaatctcctgcttcgggacgcgttcaatctggcgtttgtatacttcttgggatttcaggctgttttctgaatccttcataagcttttccgccttcttcggatgtgcggcaagccagtaatcaatgatatttcgatccttcataaattcagtatcaatatgaatcagtgcggcgagattttttgccgttttcaatttgtcctttgccgaggtttttgaggtagaaacgtatacaatttcaggcacagcctggttatcaaccgccactctgttccgcttgtcatacatctttccccgcggtgtcggataataggcggtttttgcatttgccttctccgcatcctggcggtgtttatccccttcgacaatctggacgatgccgagtttaaaaatcagtgccgtaaagagaaggaaaacaactaaaaaatagagattcattctcagcgctctgtaacgtttcgtttttttctttggttcacgcgcaacttcagccactttctgttacacctctcaaatcattgaatatatttacataaacagattttaattgtaacatttttgtaaaagttgttacagcgaaaacgggtaaaaaaaactgtcaagatcaaattatcttaaaatatatctaacacttcaaataatttgaagagatgtaacggattttaaaaaataaatacagatcgtttttcccggtatagagccatttttctgcgctcaattacaattatgacaaacgtttgttgtcaaaggaaatggctgcctgcattatgacaaaaaagctgtgataagatttttcatgtagaaaaaaacaacttctctgggaggctataaacttatgaaaaaagcatttctcttatctgccgccgcggcagtcagtttgattacattcggaggcattcagcaggcatctgccaaagagctgtcatgccagcacgtcgttaccgtgaaaaaaggaaacaccgtacagcatctgactcttcaagaggctattgaaaaactacatatgaaaacgagcgtgaaaaagctgaacgttaaaaatgagaaagaactgaaacagcagctgcaaaaacacgcaaagaattctgatatgacagttaaagacgttcaaaaagaaacaccggcaaaaacggcaccggcagctgccgaaaaaccgaaagccgatcaaaaccagcaaaaccaggctgctgacaatgcaaagcagacaaataacacaaacaacagcagcgagaaaactccttcttctgtcagtgcgtacgaaaagaaagtcgttgaattgacaaatgcagagagacaaaagcaaggcttaaaacctctgcagattgatgataaactaagcaaatcagctcacgcaaaatcacaagatatgaaagacaaaaactatttcgatcaccaaagccctacttacggctcacctttcgatatgatgaaatctttcggaatcacttataaaaccgccggtgaaaatatcgccaaaggccagccgactcctgaagccgttgtcaaagcttggatgaacagtgaaggccacagaaagaacatcatgaatcctgagttcactcaaatcggtgtcggttacgtagaatcaggaaacatctggacacagcaattcatcggaaaataatataaaaaagattgccccggcgggcaatcttttttatttcacccaaagcttataaatactttgagttccgctgttttcttcaccttgcgcggaaagcttgtcgtataatgatttggcgagcgccaatccgggcatctcttctcccatcagttccgcttcttcaagggcgattcccatgtctttaataaagtgtttcacgtagaatcctggtgcaaaatcgcctttcagcatacggggagcgaggttggacaatgaccagcttccggcagctccggttgtaatgcttttcagcacttgttccgggttcagaccggatttttcagcgtaagccatcgcttcagccactccgaccattcccgctgcaatcgcgatctgattgcacattttcgtatgctggccgctgccggccggcccttgatactgaatgttttcccccataacggagaaaagcggcaggcatgcttcaaacgcttctttttctcctccggccataatggcaagcgttccgttcctggcgccgatgtctccgccggaaacgggtgcatccaaggcgtgaatggacttttctttggcctgctccgcaatctttttcgccagagacggttttgatgtcgtcatatcaatgacaaacgtcccttcttttgcgtgccggagaatgccgttttcgccgagatagatttcctcgacatcactcggatagccgaccatggtaataatgatgtctgctttctctgaaaggtctttgaccgtctcctgccagaccgctcccttattcagaatctcttccgctttttgtttcgtccgcgtgtagactaaaacaggatagcccgcttctaaaatgtgcgatgccatactgtttcccatgacgcctaaaccgataaatccgaccgttttgttcactgcgctttcctcccatgatgcgattcataatatcattctttcatgtctatattaccatattataggctgatagagaccgcgttacaaggtgaatttagaaatcgcgctgatcagatcttcgctcgcgctctttaacatgtcagtcgattgcttcactttttcaagcgtaacgagctgttcatcagtagaagcattcacttcttccgcggctgccgcagattcttgagaaatggcggagatgctttgaattgcttcttgaattccggcttgttcttcactcattttttgaatgtcattgtaaatatgatctataccttgaacgagagactgcatttccgtcgtaatcagattgaggacctcacccgtttcatgaatggcgctgttttgttcatcattcattctgcttgcctcaatcatcgcgtgtgacgcttcttttgtctcagattgaatcagacggaccgtctcactgatatggccggaagaaagagctgattgttcagcaagcttgcggacttcttcagcgacgacggcaaagccccggccgctttctcccgctcttgcggcttcaatgctcgcattcagcgccaagaggttcgtctggtctgaaatggcggatattgccgtcacgacttcttctatgtttttcgtttgttcttccaggtcattcagcattgcctctacttttttcgtttctgaattggcttcgtttgacttcatcagcagctgcccgagcgcgtccaatcctttgtagctggcatcctctgaagattttgagagttgttttatgctgcccgcgcgatctgcgattccttttattttgaccgagagattttctgatttttcattgatcgtctcaacctctgacgcttgctctgtcgctccggcggcgacttcctctatcgcttttgcgatttgtccgctcgtttcatttgtttcttgtgaaatgacggttagctggtcagatgtatcagacacattttctgaggaggccttaacctgttcgaccatctctttcatattttcaaccatttggttaaagtcttttgttaactcgcctacttcatcttttgatttcgtctgggcgcggacggttaaatctccagctgagactgaatttgttttggcgatcagctgctgaatcggcccggttatcgtttttgctaggaaatagctgagtccgatcgtaatcacaagggcgatcagtgacataaaaatgctcaccgtgttcattttatcggctactcccatcagctgatctttttcaaactgcgttccgactttccaccctgtttcttttaccgtttggtagacgaccatgttcccctgcagctctttgacgccttctttatccgtggtgatgtcttttaacgtctgatcttccgaaatattttttccctgtttttccggatgcgccagaagagagccgttttcatccgccaaaaacgcaaatcctttatacggtaccttttgctcgttgaccatgctctgaatggaggacagcttcagatctaagctcgccactccgacgacggttccgctgttttgaatggcttttgacgccgtcacgatcatgtctcccgtcactgcatctttataagggtcagtccagacaaccttatcgggtttttcagccgccatcttataccacgttctatttgtcggatcatagtctttggcaaaatcggcctttggatatgtaaacatttgtttgtttgcggttccgacgtacgcaagcgcgacatatttgtcattctgtccgatctgttttaactcatcgttaaaaagccgcgcggtttctttgttcccatctgatagaaaagaccgggacaattcaccgcctgctaatctcaataatacggtctcatcatttttcagctgaagctcaatgttctgaccgagtgaattggtgacattctctgtcgtacgttttgcttcctccgtcatcatcggctttaatgtcaaatatgaagaaaccgttaaaaaaacaaccgttacgataagcattgccgatacaaacacagcaattttgatatgcatttttttaaacataaccatcccctcctgagagttatatcggtctttcggccatgaaaatgaataaaccttgaaataaatatcaaaaatttccgccatttggcgcagcaaaaaaagagccgtcatgccgacagctccgccttacgtaaaatattcgattttcgctttcggaaaataggtttcgatataagattccagtgtttcccttaaagcatgctcttcgtctttttggtatatatacttgccgattccgtagcgtccccatttgtatctgcgcttttcttcatcaagctcaagctttgttttcggatagttcttctcaatcacccgtttggctggttttgtaaaacggtgctggatcagttcaaatgtgatgtcatgccgaacgtcttcatcaagcgccgcatccagtttctcaaacagttccttatagccttcctcccagccatcgtgaatataaatcggcgccacgatgaaaccgagcggatagcccgctttagcgactttcacggcggcttctatccgtttgtcgagcggagaagttcccggttcaaagtttttaatgacataatccgcattgatgctgaatctgaacctagtctttccgttatgttttgcatcaagcaaatgatcgacgtggtgaaatttagtcacgaatctgagctgtcccaattcgctttgtccgaaatgttcaatggctctttttaatgtatgtgtcagatgatcgattcctacgatatcagacgtacaagaggcttcaaatcttgtaaattccggcgcccgttctttcatatactcatcagcctgatccagaatctcttccacattgacatatgtccggatgtagggctttgaccccatcgtcgtctgcaggtagcaatagtggcaatgccccatacagcccgtcgcaaatggaatggcatattcggcggacggctttgaagaatcgaatttcagtgttttccggacgccgattaccaatgttgatttcgcgttccggtattgctgcaagtgatttttccctggaatattccggacttgattatgcgatgtcgtttctctgatctcaagccccatgttttcaaacttattcttcagctcttgtcctaacgggtattcgagcgctctcggttcaatataaacaagctggggcacaaacggcttcagcatagacagacactccctttacatattctcatgttgttactttccgtttaaaagagagtgaatatgcgttgtaaacatttcctttgatcaatgataccggtcttcttcaaaaagctcgctgtaaagcgcttccgcttcctcatatgtcgaaaagaccgcgtcatcttcggccagcggatgataggtttcgtataaaaacagagacaactctccctcatgatacgggtgatggacgatctccgcctctttaatatgggcaacattggcggcatgcggattgcggtaaatcacatagaccgtatcccccgctgcaaatgattttgtcatgataatccctcctgttgaaagttattgttccccccttttttccgaatatgacaaaaaccagacggcttacaccgtctggcttttgtattacttattgaatgtttctttaacgaatgcgacaacctcttctgtcgtgctcatagacaagattgtttctttgaatgattcagcttcttttttagaaagcttgctgatctgcgttcttgccggaaggatggatgtagcgctcatcgagaactcatctaagcctaagccgagaagaatcggaatcgcaatttcgtctcccgccatttctccgcacatgccgacccatttgccctctttgtgagcggcttcaataacaagggtgatcagacggagaatcgccggattgtatggctgatacagataagctacgcgctcgttcatgcggtcagcagccatcgtgtattggatcaagtcatttgttccgatactgaagaagtcaacttctgcggcaaactgatctgcgataacggctgtagacggaatctctaccatcataccgacttcaatatcgtcagaaaccgctacgccggcttcgacgagtttttctttttcttcgagaagaatcgctttcgcctgtttaaactcgtttactgtcgcaatcatcgggaacatgatttttaagtttccgtatgtacttgcacgaagcagcgcacgaagctgagttctgaagatttcttgctcttcaaggcaaaggcggatggctctgtagcctaagaacgggttcatttctttaggtagctgcaggtaaggaagctctttgtcgccgccgatatccaatgtccgcacgacaactgattttccttccatacgctcaagaaccgttttataagcgtcaaactgctcgtcttccgtcggaagctggtcgcgtcccatgtaaaggaattccgtacggtaaagccctacagcttctcctccgttttcaagaacgccttttacatcgtccggtgtgccgatatttgcggcaagctctacatgatggccgtctttagaaacagtcggttcattgacgagcttcgcccactcagctttttgcgccaggtaagcactgtgcttttcttcatatttctttaacgtttcactggaaggatcgatgatcacatcaccatcgatgccgtctacgattaccgtaacaccgttttcaattgtccctgtagccgcttttgtgccgacgacagccggaatttcaagcgaacgggccatgatcgcggagtgtgaagtgcgtccgccgatatcagttgtaaaaccttttacaaactgacggtttaattgcgccgtatcagacggtgtcaaatcttcagccacgataacaacctcttctgagatcatgctcgggttcggaatttccacgcccagcaggtgccctgtcacacgttttgttacgtcacggatatccgccgcacgctctttcatgtattcgttatccattgattcaaacatagtaacgaacatggaagctgtttctttcaaagcgaattcagcattgactgaatctgtgctgattttctcctttaccgggttcaacagctcaggatcactcagaactaaaaggtgcgcggagaaaatgtcagctttgtcttgtcccagttcttttaaagcatgctctttaattttttcaagctcttctttagaacgtacaatcgcttcatcaaaacggcttacttcagccgcagcatcagcaatgtttttcttttcaaccgttaagtccggctcttcaagccggtatgctttcgcaatcgcaattccggctgaagcgcctattccttttaattcttgcattactcgccgagtccttcgcttttcattgtttcttctaaagcgttaagagcatcgttttcgtcagcgcctgaagcggaaattgtgatttcagcgcctttagcaatacctagagacataacgcccatgattgacttaaggtttactgttttgccgttatattctaagtttacgtcagcatcgtatttgcttgcagtctgtacaagaactgtcgcaggacgagcgtggattccggaatctgctgttactttaaatgttttttgtgccatgattatcattctcctttaaattaaagctattttactacacaatattatatcatacagccgtacttgtcatctgacaagcacggcgtatttatatgcttattttccgattttcacaatatctttttgttcccgttttacggtaccttcggccgaaagggaaatcgcttcaccctcggcaagatttgtaaagacaatcggtgtcattaatgaaggaacatgaggtttaaccgcttcaagatcaacttcaagcagcttttgtcccggttcaacccggtcaccctcagaaacaaaagaagtgaatccttcgcctttcaggctgactgtgtcgattccgaaatgaatcaggatctctcttccgccgtcagactgaaggccgatcgcatgttttgtcgggaaaacattcagcacttttccgcggacaggcgatacgacgattccttcttcaggaagaatcgcaaaaccgtcacccatcatttttcctgagaacacctggtcaggcacatcggtaatcggatggatttcgccggtgatcggagaagcgaacacttcttcaccctgctcgtttcggagcggatctgcgataacctcttcaacctgctggctgacttcttcttgcgcggatactttcggttcagggcgcggcgtgcgtccggcgataatatcctgcatctgtgtttttaaaccgtcagaacgcgggccgaaaatggcctgaatgttgtttccgacttcaagaacgcctgaggcgccaagctgtttcaaacgagtcttatccactttcttctggtcgttgaccgtaacgcggagtctcgtgatacaagcgtcaaggtgcttaatgttttcctgatcacccattgcctgcaggatttcataaggaaggtcgccggcttcgcctgaggcgcccgcaccttcatccgcagcctcttcttcacggcccggcgttttcagattgaactttctgatagcaaaccggaaaccgaagtagtaaatgacggctaatcctaagccgaccggaatgacaagccaccaagccgtccggttaggcagaattccgaacaggaagtagtcaatcagaccgcctgagaaggtcataccgatttttacatgcagcagctgcataaccataaaggaaagtcccgcgaatacgcagtgaatcgcaaacaggataggagccacaaacaagaatgagaattcaagcggctcggtaattcccgttaagaaacttgtcagagcggcagaacccatgattccggctacaagttttttcttttcaggcttcgcttcatgatagattgcaagcgctgccgccggaagaccgaacatcataaacggatatttccccgtcataaatgttcccgccgtcagctgtacgccgtctttgatctgagccataaaaatccgctgatctccgcggatgatgtctccggccgcatctttatagctgaaaaattcataccagaacggcgagtagaaaatgtgatgaagaccgaacggaatcaatgaccgctcaatcatcccgaaaataaaggccgccaaggttggattcgcttccacaagacccgtggagaaggaattcagaccgtgctggatcggaggccagatcactaacataataagaccgagaattaatgcggaaatcgatgtgataatcgggacgaaccgcttacccgcaaagaatcccaggtactgcggaagttcaattttataaaacttgttaaacaataacgcggccagaaccccgacgataataccgccgaacacgcccgtcgccaaagtgggtatccccagcatgttaatataggccggatggttttccgcaaaaaactttgcccgttcaattttgtcagacggaatactgccgtttgccataagcacggcgctcatggatacgttcatgaccaagtatccgataatagccgcgattccggcaacaccgtctccgttggcaagaccgatcgcaacccctactgcaaaaagaagcggcaggttgtcaaatacgatttggccggcgctttccatgacattcgccacaagctgaacgttatcattgcttaagaagtgcatgacttgaatcatatctttgttctgcatggcattccctaacgcaagcaagatccccgcagccggtaaaatcgcaaccggaagcataagagcacggccgattttctggagaacgccgaataatgctttaaacataaaagatgtacctcctctgttagctagtgtgaccttacagcgaaaattcatgacaacgaattcactggcgcaagtcttcagtttaaccgtttacatttgcccttttacacaacaaaaaaggcatgagtaaaaagggtgtgcaaaataacgggaccgttcttcccgttttttaccctcaatcactcatgcctgatcgaatcagtgacacgtttttaaggtttcaactgaaattatgaaattttattggttaatcggtacaaatgaagcgtgagataaaccgcttccgcctcatgaactggctttttcagtatttgctgcaagatttttatcagtttccaagcagtattgtagcatagcgggtattcatttttcaataataacattaacttttctggttcttttgtctgctcttcccgattaatcctgtctatggtaaatctgatatgccggatcagccgcaaatagtggacgctttctttattcactttcatctggaaagattcctcaatcacctgaacgagccgggacatcagctgtgaatgctgattgacctctgaaaggggccgattcgtcagggcggagtggatatgcagagcgataaagccgatctccccttccggaaggcagattcccgtcttttcattaatcatgccgacgacttcacgggcaatttggaattcttccggataaagcgtttcggtttccatgagaaacgggtttttaatgtcaaaaccctgctgcagccgctttaccgcaaatgcgatatggtcagtcagcgcaatatggatatgctcatttaacggttggcttgtccgcttcttgatatgataaatgacgtcattggagatgtcgacaagtgtctcgtccacataaccgaggagctttttaaattgtttttgttctttttcatcctttaagatgaacatcttgtcataccctttatcttcaatgacatccgcttgtttttttccaaagccgatcccttttccgattaagacgacctcactgtatctatcatgtgttgcgatgagcacattgttatttaataccttttcaactgtaaaggaccccttcatgatcctcagctcctttgtcattcaatacctcatatcgtacaaaacgaacggaaagcgcgtcaattctttttttagacggttgatcgttcaataaggcggtaatcaagaactttccttgccggaggcccgccgctgatcctgttctcaagcatgtgaaaagcctgctttcccatttcttttgtttgtatatctattgtggaaatacctaacatcttgctgatatcatgattgtcgatgctcaaaatcgcaagctcttccgggatgcgcgtcccgtttgccttggcttcaaggtaaagacctgcggatacttgatcattcgccgcaaacagcgcagtcggtctgtcatcccagctcttccatctatgaaaaagggctttcccgtcaagcagcgtcagcgccttttccacaaccagctcttccctgtaaggctgcccgaccttcttgagcgcttctttgtatgcggcaatgcgtacttgactgttttttcccttttttctggccaggctgatcgctattttccggtgtcccttttctatcagataatccagaccgtgccgaaatgcttcccgatgcggattactgatggaggaaagccctgccgcatcagtgtactggcagagaatgagcggttctttcacggtaagcagatgttcatcaggaattgctttggagcagataatcaggccgtccacttggcgctcctgtaactgtgataaggcaaaacgttctttttgctgctgataatctgtctggtataaagaaagatgcacgcctgacgcttcggcagcctcggcaatacctgcaacaaggtccgcaaaatacggaagattcactgacggaagcacaacgccgatcatatcggaaaaacctttggataaatgtacagcatgaatgttgcgcgaatatccgagcgattgcatcgcttttttcactctttctcttttgtccttacttacataaggatgatcgtttaatactcttgatactgttgtaacggaaaccccggcagcgccggcaatgtctctgatcgtagccattgcgtcccccctttcttttttcccttgatctggaatgcgtttcatacagtaagctagaaacagaaacagcctattcgtttgaaaggagaagaacagcgatggggattctttgcttaatcggtttgtgtctcgccatactcggcggcagttaccttgccatgcggcccctgaatgaaaagcatgacatcaaaccatttcagcattttgatgattttttcatttaaaaggtgataaaaaaggacgctgcgttccagaaccgtccttttttatcacaaagctttctatttcagaatcgttaattctttcgggtactgcgttaatgcttcggcgccgtcttttgtgacgaacacatcgtcttcaatgcgcacgccgccgacatccggcacgtaaatccccggttctatcgtgtataccatgccttctttgaggagtgtgtcgttcgcgctgctcattgatggatattcgtgaaccgaaatcccgagtccgtggccgaggcggtgcgggaaatagtctccgtatccggctttttcaataatgccgcgggcttttaaatcaagatcgccgattctgacgccgggtttgcttaattgaagcgccgcctgttcagctttaagcaccgtttcgtaaatctcttcctgtttcgggctgattgattggtatgcgaatgttctcgtaatgtctgaacagtagccgtcaagaataacgcccagatcaaacagaacgaaatcgccttttttcaaccggtctgcacccggatttccatggggctgtcctgatttttccccgaacagcaccatcgttgaaaatgacatgccctgcacaccttttttcttcagctcaaactcaatctgcgcgagtacttcggtttcactcacaccctctttaagcgccgcgacaccgacttcaactccgtaatccgcgagttttgccgcttccctgagaatgctgatttccttctcatctttcacgagacggaattggttgagcgtttcttctgccgaaacaaatgccgcgccccctgaagcttgtttgagctgttctgagcgggaaagagagatcgaatccttttcaaccgcgatggaatcaagccgcacatttcgttttgtgagctcggctttgatcagctcccacggatcttcgtgatcgccgtagccgataatatcatgctcccacccggcgctgcgggcttgtccggcttccattcccggacaaacgaaaaacggctcctgttcctgaaacaggaacaaccccattaaccgctcatgcggatccgtgtaaaaatcagttaaataaaatacgttttcctttgtatgtataaacgccgcatcatgtccttcttttttcagccaagatgaaacacgttctaatctgttcattttttgcttttcctccttaccaaagtgactctttattcattctatcagttttccggcgtttatgctgtgaacgaacattaaaaaaacagccgcccgtgtgcggctgtcatgtttattttaataatctcagtccgttcagaatgaccagaatcgtgctcccctcatgcccgatcacgccaaacggcagttccatcacctgaagaaagttggcgcagatcaaaaggcagatgaccgagagcgagaaaacaatattctgcttaataatccggttcattttccttgagagtctgcacattttcacaagcttgtgaagatcatttttcataaggactaagtcagccgtttcaagggccacgtccgttcccccgcccatcgcaataccgacgtcagcggttttcagagcgggcgcgtcattaatgccgtcccccaccatggcgattgtgccgtacgtttccttcagcttcttcacttcttttgccttttggtccggcagacaatcggcaacaaccgtcgtcatgcccgcctcttttgcaatggcagccgcagtttcagactgatcgccggtgagcatggctgttttaatgcccagtgattcaagctcagccatcacggctttggcttcaggtcggatttgatcctttaaggcaaagcagcccgcaatccggtcatcttttttaacaaagaccagtgtaaaacctttatcctttaattcttttcccgatgtttgcaaaaaagcatctgccgcatcttcacctgcaaaccccgcttttccgaccatccatttgacaccttctatttcagcctgaacaccgaatccggacgtctcgtcaatcgatagatgtcctgcgggcgcggcgccccggctttcggcaaattcagctatcgcttttgcaagcgggtggcttgattgcttttccatggcatacaccgcctgcatgatctcatcttcactcacatgttccgcagcttgaaatgccgcgactgccggctgtcccttagtgaccgtgccggttttgtcaaatgcgatcatccgtacgcttcccagctgctctaaaaacacacttcctttaaccaataatccgttgcgggccccatttgagataagggaaagcgcagcgggcataatagaagcgacaagtgcgcacggggaggcgaccaccataaacaccatcgccctgtaaaaggtttcactccagctccagcctaaagcgaaatgaggaatgaataaaagcaaagccacggctaacagcacgcctttgacatagacactttcgaaccgctcaataaatgcctgagccggtgacacgctgttttgggctgattccaccagccggatgatttttctgaataaagactgttcatttgttttcgtcacacggaccgttaaggagccgtttccgtttaccgttcctgtaaacacagaatctccggctgttttttccgccggcatcgcttcacccgtaagcgccgattcatcgaggctcgtcacgccagactcaatgatcccgtctgctgctacgcgttcgcccggcttaatgacgatcatgtcaccgatcttaagttcagcagccggcacccgcttttcccgtccgtccgcaagcagtgtcgcttcctccggttccagtttcattaaagatgttaaatcacggctgcttttattcatcgtatatgtttcgagcgcgccgcttaacgaaaaaataaagataagaacagcgccttcagcccaataaccgatcagggcggagccgacagccgcaaaaatcatcagcagttccacatttaacgccttcgtctcaatggtatcctcaattccctctttcgcttttgcaaatcccccgatcaggaaggcaaggatatacaaagtgacggacaggccttttgtttcggtaaaaaaccaggccgcaagaataaggacgccggatacgagcgccgcaatgagttctgcatgctggagccacttttttccggcccgctcttcttgtatgtgctgttgtgaatgggtttgtgtcatcacttgttcattcattatgaattctcctctctaattgagaacgcaaatcatcttcaattccccgataaaagcaaaacagccgcctgacaggcagcattttcacagtgttatcgcagtgttttctttattatagcatgccggcggaagatttcaattataattgttttaatttctttttgataataattatcattagtgtttcttcagctgttcattatatgcaaaaaaggtgcgggaggaattcctcccgcacctttttatttctctgaccattcttttaattgtgaggcggtcatcggaccgacgatctttttttcgatttctcctttttcattcagcagaaatgacgtgggaatcgtcatgacatcgtattccttcataagctcgcctttcgtgtcaagaacaatcgggaaagtgagatggtgctgactgacaaagttttgaacggtatttttgtttcgctcggcattcatcaaatttaccgttacaaggcttacatcatcggactgatgctgttcataatacgtttggaactgaggcagttcttttttgcacggcggacaccacgatgtccaaaaatgcaaaatcgttttctgccctttattcggaatcgatatctcgtctccttcaatcgtcttcatcagaaacacggctggaactgcctgtttttctgatgaggcttttgcttcaggcatccagacggcggcagctatcaaaaggactgcacatacaattaggcggtttttatgcatatgatcttcctttcacgcgtttcggatagcttgcccttccttattgaaatgtatcagccttttcagctttcgatccggggcgctgttcttccgccgcccgtcaaaaacacggagacaccgaggtctttgcagatcgtcgcgtaatgtaaacttgtcagaagaatcatgccggtattcatgccgagtataatgccaagcatttgcaattccggcatagaaccgagcacatacatcatcgaaagccctacaatgctgctccatacgttatgataaaacgccgttttcacgtggccgataccgatcagacaggcctgaagcggcatcacaaacagatgaaaaagaaaaaacggccacaaaagctgcaaataatactgcgcttccggagactgaaaaaacaaatgggtcagcgggcccgcgaactgaaacatgacccagactgccggaatgccgtagccgaatgtaataaaaatcgcttgtctcagccgtttcagcacaatatcatattgggacagcgcatacgcttctgaaatgctgggaatcatgacgaccatcagcgaatgggcgataaatgcgggaaacgaaccgattgtcatcgcaacaccggcaagcatgccgtattgatcaatcgcggctgtcccggctgccccggacgccagcagcgctcctttcactaaaaagggttcaatggcgttcgtcaccgcatgaaatatacgaagtcccgttgtcgggatggatacggccaggaggcgtttccgcacgtccttgccgcgcagatgaatgtgctgatggccggaaagcgccctccgcgccaaaataaactgcgtatacaagtaaacgaacaccacgacatcgcttgcgaccagcacaaataatgaaatgagcacggccatatcaatttcaaaagagtaccattgaaaaaagataaacagacaaagcacttgaatgatttttttcatgacattcgcaaccgcgatttttcccatttgctgcacacccataaaataacctctggcgatggatgtaaaagcgacgactggaatcagcccgatgacaatccctttaataaacgggtgatacgtatcgaatacaggaatgaacggcagcgcgatgcttgcggccgcggttgaaaacgcggtaaaaacggcggtcattctgaaggcatgccggagcatgctttcatgcagcttctgattggattccgcgatgaattttgaaatggagatcggaagctccagactggcgatgacgataattaaaaaaatggtgggcagaatgctcatgtaaagtcccatcccatgctcgccaagctcccgcgccagtatcatattcacgacaaattccagacattccgcgaaaaaggcggcgatggataaaagaatgatccctttcacaaatcgattcatggtgtctctccttgtctctcgttcttccatcatcatatgagacaagttctgaaaatattttcgatttctcaaaattgaaaaaagcatagccgggatatttttgatcccgctatgcttacatcgcaaatacgtgtctgccgatccgttcgataatttttcgggaacggatccagtggtcagatgccgttttcggattgtagaaaaacaacgcgttcgtttctctgcccggatggtcaagcgcctcatttgcggcggcgatggaatccttatccggcttttgattaatgcttccgtttgctaccggttcaaatgcattcctttgatagatcacaccccgaatggtatccgggaagccgtttttttcagtgcggttcagcactacgctggctacggcaaccttccctttataagattcacctttcgcttctgcgtgaacgagacgtgacagaagttgtctgtcagcgcgggaatacgtttttttcggcggctgataagccgtctcttccggttttgccttcttctcttggtgagatgacagctttatcggttggatagaatgcttatgatccgtttttgaaagcttcggaaccgagctttttttatttaaatcagcaaccagtgtgctgggttcttgctttggcttcttcgcaaaagtaaacagagcttctgtatgttcaatttttgatgcaggcataaaacatagaaaaaagacagccaaggcagcaaattttgtcgtcatacgatttcctccttaaatacttcactaccttaacaagagctgtgcacaaattcacggttaaagattttccagtgctcccaatcagcttttatgatggaagaagttcgttaacagccttgttattggcaggaaaacagccgtcattttcacaacattaaccaaatagcagtaaaagtatccatcggagggattttacattttgtttacatctgttacagcaagatgaaatgagaaaccaaaaaacaaaaaaaagactcctcaagtgcgaggagccgtcagcttcttggctgttctaaatactgaaatacaacatctccgccctgctgtgcaataccgcggaaatgcttaaaatcttcctgcttcgataaaactgctcgaaatgcaagaaaatgttctttctgcaccctgaattctttgatttccccggtgcgcatttggttgatacattctgaaatttcctcaggcagcaacgaacacagcctccttttctcggctttttcccgaaaatcaatatatcatctttcccccgccgggacaatgattgagcgggctgatacccatatcgctttacttcttaaagaaaatactgcaaaatattttcaaacaggatttatgataaaggagaggaagctcgtgaaaattgctaaggttggaaacgtcattgaatttaaaaacggattaaccggtattgttgaaaaagtaaatgaaaactccgtcatcgttgatgtaaccatcatggataattatcgtgaccttgaattagattccctcactgtcgtcaatcataagaattataaaatcatcagagactcctattaaaccccccgaacaatccgaaccatttacatatcccgcacaaaagctgccgcccggcagctttttcaaatgaattcagatctcggtcatttctacaaaaaaatcacctgtctcatctttattgtaaagattagtgacggatgtatagtagttggttattttaccgcggaattcaagcccacgctcgggcgccttgatgtcaaatgttttttcatacaaaaggacggcaatatcatgatacgtttcagaggtcaccttcaatataaatgaaatcatgcggccgttttcacccgcactttctttacaatcatacattttcagtcttacaccgtttaactctaacggctccataacgaacactccttctttttacaggacatgctatcatgctgaccattcctttacaattgatccgctccgaatgagaaaaaacagcgcaggcctttacaaacatatgttccctattttataatgaaacagacgagctgccatccagcacccgtcttttcattagaaagcggcgagtggaattccccccggattcgctcgtcttttttatgtaaaaccccctcatttctgaggagaaactatatggtcgattatcaacaagtcatggttctccacgtaccttggcgccttgaatttccccatcctttaatgagagtggtcaatcaattctcatcatgttttttagataaaccagcatccattcaggatagagattcattgcaattatcttcgaattttgctttgaactataaatcattatatatttttaaacactgtattccagactgacgcatcctcttgtccaagactccagctgccaagacctttcagattatatttttgagcgagttttatttttgctctgagtgactgttcattttcaaaccataatgtatatgttcccgaaggcaacagccccttgttatcgtgattgacagtaaaaatagcttttggagattgactctctgtgtcaaaaataattgtcccgttatgcctttttactaatgagtcaacaaggtaaaggggaatggcttgagaggcagattggcctttcatccaacagcggccatagaatggcaatcctaaaactagtttttcaggagagattttttgggtcagagcatattgaatggacttttccacccatcctacacttgcagtaggtccagcaaggtggctttcatcgtaggccataatcataaggtaatctgcatatttagctaaatactcgtaatcatatgatccgtgccagcccttcgtccagccaaaaggatttgccgccactgcaactgatacttctttatgtctaggaatacttttccttaccaatctaacaaaatctgtaaataaattccgatctttttctgtaaggttttctatatcgatattaactccgtccaaatccagttcttctattgcatgagaaatttgtttagctaaaagaactcggttcattaatgaaaatcgccccaaatcctgatcccaatgattgcttagaaaaggaactacttttaattttcttctatgaagagctttaatcacatcgggattagctgaacggagaagtaatgatccatcttttctgatatagaaaaaatcaggagacacaacatttaatactccgttcgtttgatcaacgtgttgaataaaatcccatcctaatccagaatagaaatagctcatttgaaacatctcataaccccttcatccccaaaaatatcaagttccccacaaataaaaaaatgaggattgtcatttcaatttgattcgtttccgaaacctcaaagattatctttctcttatctttataatttgtccaggataaattctatctgaagaaagcttattaagatttataagttgttgtaccgggatattgaaggatttagaaatcgtccataatgtatcgccggattccacatgatatacttcgtatgtcacgggaaattccatataacgaggcgttctttttactttattcgcttgatttcttattttaggtattttccccttcattcatattactctcctttagaaaaatttgttatcaatatttctaaacagtttctctctaatcttaatgatttgtccagcatatatttgatctgatttgaaatgattaagctccatgagttgctgcagggaaacattatacttcctggcaattattgataatgtttcaccgggagtaacatgatggatcacgtatttttctttgagaacatctacataatgaatggttttccctaagtttcttataattcctctgctttttagcacctcaagcattctctcggctctatgcagataggaatcattctttacagcctttttaccgtttatctgaatcttttttctctcgctatcatgattcaaatagtatttaaccttttccaatgtttcttttggggaggaagaaacgatgagatcgcggccaggtttgaatttacctcgaactgctggtgtatccgatgtcaataaaacccccccggaaccaagaatctcataggtgcgttgcgtaagttggctttcacagttttgcaaaccgataacgacttttgctgaactgtagactttatatgcttcagtataatcaaggtatccatggatccaattgcggggaatttctcttcctatatatttactcattttttcccagtttctcccccaaaaatcaatgcgaatacccttccgtataagaggacgaataagcgtttttaaagaggacgaacggaacacttccggatgttcttcaagaaaattagggtaagcattagccaccactgctatatcacaactgtattttgctaatggtttaatctggtgatgtatactttcgtgaaatgcaaagtctaagtgagctgctttaatccccatgctttcataagttttacacagagaaggcgtaaccgtgaaaacaaaatctggtttcacctttttaattaacgggatagtaaagttttgagtgtgcagcgggtcttcagttgcccaataaacgagagggatattcacctttttagtagcgttgcgaatccaggcctgcttttcccttgaatgctctggtgtccatcccatagatactattagatctggtttaaattcgtctatcatttcagtgatattttcccgacttacaggaccggaaatcattacggtatgtcctgcttccctaaacccatttggtaaaccatagagccacatgggatgactctcgaggaaaagaattttcacacattttcgccctctctttcactttttaatgtctactttattggtatgtagaagagaaataatttgtcgcggtaccagtctataaaaaatgttcaagtgcaagataacgtgattgggatatggatgccccacaaaaaaagaaagcaatctacaacatattttcctttgattttgttagcctttctgccaaaatactttcgttaataaattgcttttgtgcttaaaagaaaaagacgtacacatttgtacgtcttacattacctctgcaatagcaatttatttgcataaaagtcataataggcacgcttttatagtgattaacgattatcaatcgtctccggatacatatcatgattcatcatccgatgttcggccattttttcatattttgttcccggtctgccgtagtttgtatacgggtcaatggagattccgcctctaggcgtgaatttgccccatacttcaatgtagcgggggtccattaattcgatcaagtcattcatgatgatgttcatgcagtcctcgtggaagaaaaggcaggtcaaagtcttgtcccataagtacttgctctagacattaatcatgaagtcacaccaatttcacaccttaccaaggggactatttgtaatctctgcacagtgaaattatacctgtgctagcccgccatctacgaacaattcaacacccgtcaagtaactgctttcgtctgaagcaaggaaagatacagcgtttgctacttcttcaggtgtcccaacttttccagctggaacagtatttctggtattttccattgctccttcaagtgcatcaccaaaaagctcatcgtatgcaggtgtaagaatagctcctggactaaccacatttacacggatttcagtaccttttaggtcaagaatccagttgcgaaccagtgctcttaatgctgctttagatgctccatatacactaaacgctgggttgccaattgatccagcagtagagcccgttacaataatagaacctactttgtccgggaatagtgataacgctttttgaacagtaaagatggttcctttaacgttaatgtcgaacgttctatcaacctgctcttcagtaatttcacctaatggaaggaagttgccggtgcctgcattagcaaaaagaatgtccaacttacctttttcctgctttatcatgtcatatagtttgtctaagtcttctagcttagaaatatcaccttgaacaccggttacgttcttgccaatttggttaacagctttatcaagttcgttttgtctacgtcccgtgatataaacatatgcaccttcgtttacaaatttttgtgctgtagcaagaccaatcccacttgttccacccgttacaagcgctattttaccttcaaatttacccatacttaacactcctttagaattgattttattttatgtctagtacctttaagtacttgaagaacaacttacaagatatagtatccttcagtaagcacattatcggaagtacccacttttttgtgatatagtaactaaaaagtaataaatgtggaatggagagctttagacatgaaaaaatttagctgtgggtttgaagtgacaaaggaagttattggcggaaaatggaaaggccttgtattatactttttaatgaatggaccaaagagaacgagtgaattaaagcgcatgatcccaaatataactcagaaaatgctgattcaaacacttagagagcttgaagccagtggacttgtgagcagaaagatgtataatcaagtaccgccgaaggttgaatattcatccactgaacttggagaatctcttaaacctatcttgcaggagctctgtcaatggggaggccattatgcggagcaaaagtatgcagaaggtgaatatgaaattgtacaaccagaacaactaaagttaggattgatgtagctgctgaagtaaatgctaaacaacttcaataccatcacctaacagatgaagaacagtcagaaataaatgagatattcaattttgaaagtgaagttctaataagaagtgtcatggactatattcaggaaaactttgatgaaattcaaaaaagagctgtttcaaatgttaaagagaaggttcagaaacttagccaaaaaataaatgaagatattgataataatatttaatgcctatgatctctagataggcattttttctttcggataaaaaagaaaagacgtacaaattgtacgccttaatctgcttctgtactatcaatttttcactgcataacagtcacagttcaggttgcacctcaggtcacacttttattgagcttagtgctggtcacacttcgctgtgactcggtcacaattccgctgaaaatcagcactgaatgttcggattttactgtgactccacttggtttcacactccgtatcacacaacggaataattaccgattatcaatcgtctccgggtacatatcatgattcatcatccgatgttcggccattttttcatattttgttcccggtctgccgtagtttgtatacgggtcaatcgagattccgcctctaggcgtgaatttgccccatacttcaatgtagcgggggtccattaattcgatcaaatcattcatgatgatgttcatgcagtcctcgtggaaatctccgtggttgcggaagctgaaaagatacagcttcagcgatttgctttccaccattttttcgtccggaatatagctgatgtagatggttgcaaaatccggctgtcccgttttggggcaaagcgacgtaaattccgggcagttgaatttaacgaaataatcacggttcacgtgtttattcggaaatgattccaaaacctccggcgcatattcaaataaatagtttgtcccttgattccccaggagcgtaactccttctaattctgattcttttcttgtcatataaatctccctttctattaaactccccgtttattgccccaaagcaatgtatgcagctgaggcaggactctgacgagattcagatccgaatcggctgaaaccttatcaacgagtgtttcgtattttccgagcagatgtgcgatcaatgcccggtcgtccgtcgtatggacgttatcgtttccgacctgaagataaaacgggatattcggataccgcttgtgcacggttttcgcgaattgcagatcttcatcattaaaaatgacgacctttaagctgaccgcgttaagcctttctgccgcatcaagcgaagacacaatgtgatcgagctttgcaaaatcggttgtcatccccgaacttggcggcttcggtgaaatcgtcaggtcgttaatcattgtgaaccaatcctgatagaccgttccctgcgtttctaaagcggcgcgcaccccgtgctctttcagcagcagaatcagcgcgtcaagctgctttaacagcgccgggtttcctcctgagatggtgacatgggaaaaagcgtctccaccgatttctctcagctcgcggtaaatgtcttccgccgtcatccagcggatatcttttttggcagagccgtcccatgtaaaagcggagtcgcaccagctgcaagagtagtcgcagcccgccgtgcggacgaacatggttttctggccgataaccatgccctccccttgtatcgtcggtccgaaaatttctaataccggaattcctttagccattcctatcaccttttttcgggcggtatacgcaatagcttgtcggggtttccctgacaaaaatctgcacgcagaccggctgattctccagtgtttcgaggtaggactgcaccttatcgtaaatcgttttggccacgacctcggtcgtcggcagtgaatatctgtcatcatcagaaaattcctcatggtcattcagcaatgtatggtcataagcgccgtgcaccaatttcttcagcacgctgaaattcacgagaaagcccgaatcgtccagttcatcccccgcaactgtaatatttactgtatacgtgtgcccgtggactctgctgcacgctccggcgctttcgcggggaataaagtgcgcggctgagatgtgcatgtccttattcaactcaaacgaataaggatgctgaacctgcggataaatttgagaaagcaattagtttcgctctcctttcattttcatatattcatcatatcctttattgcggagcaggcatgccgggcattcgccgcatccgtccgcaatgatgccgttatagcaagtcagtgtgttattctttacaaaatcgagcgcgccgagctcatccgcaagtttccacgtttccgctttgttcagccacataagcggcgtatgaatgacgaacggcttttccatcgccaggttgacggtgacattgcaggatttgacgaactcgtcacggcagtccgggtagccgctgaaatcagtctcgcaaacaccggtgataatgtggcgcgcgccgatttgatatgcaagaatcgatgcaaaggataaaaatacaaggttgcgtcccggtacaaaggttgtcggcagttccccgtctttcgcttcaatttcgatatcatctcttgtcagcgcattcggcgcgagctgatttaaaagagacatatcaagcaagtgatttttgacaccgagcttttcggcaatcgattttgccacatcgatttcttcttggtgacgctgattataatggaatgtaacggtttccacttcttcaaagttttgcatagcccataataaacaagtcgtgctgtcttggcctccgctgaacaccacaactgctttttcttttttcatgtctttctctcccttatctatcattccataaaaaaagcgcctttttcggagaaggcgccctaaaaaaacataaaaaaaccgtatccaaggatacagctcgtccttagttttttatagagggtgtagctagaacctctcccgcatcaatacggattttcttcttttttcacttttgctatcataccataatgttgtttcccgtgacaataaaaaaacagcctgaaccctgtgtcaggctgcaaaatcgggtttaagccccgcgttttttccccggaaataccatcagcgcaatcccgatcagaacaaataaagcaggccagaaaacagaaaccggaatgatcggctgattcgtcatcataaagcaaagtgctgtcaaggtcagcaccgcaaccgggatgagcagcgccttctgtttcccgccgaacagccacagctcaaataaaccgaatgccgttgcaagcaggtaaacaggccatgtcacaccggagtaggaccaattggttgccgtttcaaagacaaacaagatccccgtaatcaataagatgccgcccggtacaagaagtcctgcgtttttgacaggtttcgggccgaaaatcggaatgtgaaaagcggcgcccagcaaaagaatgagagcgggccagccgcgttcgctgatggcttcatttgcattggtgaatatgccgaaaatgcccgcggcgcacagaaccgccgcagcagtcaaaagccctctttgccttctgccgaacagccaggcttcaaacaggccgaacgcaacggcaaagaggtagacaggcgatgtcacatttgcgtatgtccaatccgtcagcgtttcaaaccataacaacccgcccgtcacaagcaaaatgccgcccggaataagaaggcccgatctttttttcggctgcataaaggcagcggcgtgaaacaaaagcgcggctgcgatgatcaaaagcggccacagccccgtcatcagcataccggcaaagcatagtgctcccacggctgtcaggatgaaagcaggaatcaatacacctaacttcctcccgccgaaataccacagctcaaacagaccgagagcaggcgcccatatataaacaggccacgtcacgcctgaatacgtccatcccgttgccgtttcaaaacaaaacaggcagcccagcacaaaaaacataccgcccggaacgagcagtcccgcctggtcaggcgtttttttcgcaaaaataaatccggcgtgaaaccctgcggacattataatgaaaagaaacggccacgccgaacctgcggatatatgaataactcccgccctctgtaaaaaaaacgcaatgccgatacaaataaaaataaatcccaataatacacgtcgagctttcatctcttactcctccccatcatttcccaattcattatacagaaatgtcaggaaaaaagaaggggaattcccaaaaaatacagacattttccttatatccttatttttctttcgggatttttttgcaaatcaatgcgccgatgaaagcgaggctcacatacccaaacaccggataaacggtggaaatcagctgtccgtagccgatttggctgataatgaaagcaaacgccaaaatgccgccgtaaatatatgtactttttatatgaagaaaactgtttaattgtttttccaatccgtataaattaccgatgaccgacgtaaacacttctccgaaaataataaacaaataaatgatatgaagcgaacgcgaatacgaatagacgacttgagccatcggaatgtcaaactccagcacatccggcagcaccgataatgataaaaagctcgcggcaagcaccagtgtcaacagaacgccgccaaaataagccccccttcggatcaccttctctgaagacatttcattcgcaagcggcacaagcacggcttgggcgagcgataaatttaacgcgccgtaagagacggcggacaaaagccaattccacttgtcaggccatacccattcgtccgcgtttctcgtgcttgtaaatacaaatgaatctgctgtcacgataaaagagaaggaaattaaaagcggcacaaccaatatattgacgccgaacacacctttaacgccgcttgtcatgacggcaaagctcagtacgatcgtcaaaaggatccccgcttgtgcggaccagccaagctgttcatgaaacagcgctcccgctccggacagcatgacagaggtcactcccagcaatataaacatcataaacatgttcacggcgcggccgatggactggccgaataaatatgtgttcaattcctgataagatgctgcatgaatccgtttggaaatgatcatgattttggcgcctaaatatgtaaacatcagaccgcttaccacgataccgaacagaccgatccagccaaacttcagaaaaaactcaacgatttcccgtcccgtggcaaaaccggctcctacaaccgtgcctacgtatacaaatgcaagctgacttgcagaaccttttgtttgtcccatttcaccctccggctaagcgcagatttgtccaggcctttatatatgcttatgagacaagtcgcccgaaaagacgaacaaatcgtccttccccggagaaaacagattcagctctctcctctaagcaaaaatattgaaagaaaaaaagggccggcgtatactcttcatcaagaaaggtcaaaacatttcatttcctttctgactatattggtcaaaaataatcaaacctcacaaatatcacttatcatgctgtaaacatttatttttcagggtttgaaacaaaacacttgaaagtcaaagaaggtcagagtatactattaatcaaagaaggtcaaagttaagaccttattttctaatccatttggtcaaagatgatcaaacatttttcgaggaggttttggcaaatgcgttgtcaacattgtcagaaaaacgaggcgacgattcgcctgaacatgcaagtcaattccattcaaaaacaattcgttttatgtgaaacatgttatacagaattaacccgaaaaccgtctatgagcatggggccgcaatcattcggattcccgtttgagcaaggtttcgctcccaatcaaaataaacagcaggccggccctgaaaaaggcctgctcgacgagctcgctcaaaacgtcacaaacggcgcaaaagcaggtctgattgaccctgtgatcggccgcgatcatgaagtggcgcgcgtaattgaaattttgaaccgccggaataaaaacaatccggtgctgatcggtgagccgggcgtcggtaaaacggctattgcagaaggcctcgcgcttaaaatcgctgaaggcgatgtgccgaacaaattgaaaaacaaagagctttacctgcttgacgtcgcttctctcgtcgccaatacagggatcagaggccagtttgaagaaagaatgaaacaattaatgaacgaattaaaagaacggaaaaacgtcatcttgttcattgacgagattcaccttcttgtaggcgccggctctgccgagggatcaatggatgccgggaacatcctgaaaccggcgcttgccagaggcgagctgcaggtcatcggggcgacaacgctgaaagagtaccgccagattgaaaaagatgcggcgcttgaaagacgcttccagcctgtcatggttcacgagcctacaatagaacaagccatcagcattctggaaggcattaaagataaatatgagaaataccacggcgtcacattcagcaatgaagcgataaacgcctgtgttacgctttcatcccgttacattcaggaccgccacctgccggataaagcgatcgacttattagatgaagccggctctaaggcgaacctggagcttgataccgtaaatgaagaagatgcggctgagagactcaaagcaattgacgcggagaaaacaaaagcgcttcatgaagaaaattatgagcttgccgcgaaactgcgtgatgaagaagcggcgttggaaaagcagctggcgcatgaaacaccggcctcttcacctgaaatcggggcggagcatattcaagccatcattgaacagaaaacaggcattccggtcggaaaactccaggctgatgaacaagtcaaaatgaaggaacttgaagagcatcttcatcagcgcgtcatcggtcaggaaaaagccgtgaaaaaagtggcgaaagcggtcagacgaagccgcgccggcttaaaatccaaaaacagacctgtcggctccttcctctttgtcggaccgaccggagtcggaaaaaccgagttatcaaagacactcgcagatgaactgttcggtacaaaagattccattatccgtctcgatatgagtgaatacatggaaaaacacgccgtatcaaaaattatcggttcaccgccgggatatgtcggacacgatgaagccggtcaattaacggaaaaagttcgccgcaatccgtacagcatcgtgctgctcgatgagattgaaaaagcccaccctgatgtccagcatatgtttctgcagattatggaggacggccgtctgacagacagccagggcagaacggtcagcttcaaagataccgttttgattatgacaagcaacgctggaaccggcgaaaaacaggtgaaagtcggattccaatctgaagagagcgtcctggaggaacaaacgctgattgattcactgagcgcgttcttcaaaccggagtttttaaaccggtttgacagcatcattgaattccaatccctgaaaaaagaacatctcgtgaaaatcgtcagcctgcttctcacagagcttgaagacacattaaaagagcgcggcatcagcctgagcgtaacggacgaagcgaaagaaaaaatcgctgaaatcggctaccacccagctttcggagcacgcccgctcagaagaaccatccaagaattgatcgaggacgaaatgacagatctcttattggatgacaacgaaataaaagccttccatgtcgtaatggaagaggacggcatcaaagtccgggcacaataagaaaaaagcggttccctcctcgcggggagccgcttttttgtttctttctccatgccgaaagggagaaactgtgaagaattcgggaacaatttctcaatcaccctaaagttccatgcactgccaccgatattaaccatagaaagctagtataaaggatttggtgaaaactatggataaaacatcgattatcggtatcatcctcgccttgattgctttaagcgtgggcatggtgctgaaaggggtcagcttaagcgcactcgctaacccggcagctattctgattattttgttcggtacgatttctgcggtgatcatcgcattccccggaaaagaaatcaaaaaagtgcctgccctttttaaagtgctgtttaaagaaaacaaacagctgacaattgcgcaattaattcctatgttctctcaatgggcgcaaatcgccagacgtgaaggtctgctcgcattggaagcaagcattgaagacgtggatgacgcatttttgaaaaacggcctgagtatggcggttgacggacaaagcgcagaatttatcagagatattatgactgaggaagttgaagcgatggaagacagacaccaggccggcgcagccatctttacacaagccggcacatatgcgccgacactcggcgttttgggtgcggtcatcggccttatcgcagctctttccaacatgaacaataccgaggcgctcggacatgccatcagtgcggcttttgtcgccacccttctcgggattttcacaggatatgtactatggcatcccttcgccaacaaactgaaacgcaaatcaaagcaggaagtcaaactgcgtgaaatcatgatcgaaggcgttctgtcagtgcttgaaggacaggccccgaaagtgatcgaacaaaaacttctcatgtatcttcctgcgaatgaacgcgcaaaagtcgctgaacaagaaggagaggcaaacaatggcgagaaaaaagaagaagaagcatgatgacgagcatgtggatgagtcttggctgatcccgtacgcggatttgctcacccttcttttggctctgttcattgtattgttcgccatgagctcggtcgatgcggcgaaattccaaatgctgtctaaatcatttaacgccgtgtttaccggaggcacgggtgttcttgaatattcaagcgtcacccctcctgaaaacgaaaaagacggcgttgatcagttaaaaaaagacaaggaaaaagataaagaacagaaaaagaaagaaagagaagcagccgaccgcgaagaacttgaaggcgtgcaaaagcaagtcaatcaatttataaaaaataaaaagcttgaaactcagctggaaacaaagctgactaaagaaggactcttaattaccattaaagacagtatcttttttgattccggacgggcggatatccgtcaggaagatattccgcttgccaaggaaatctcgaatctccttgtgctgaatccgccaaggaacattattatcagcggacatacggacaatgtaccgattaaaaactcacaatatcaatctaactggcatttaagcgtcatgcgggccgtcaacttcatggctattctcacggaaaacccgaaacttgacgcaaaagtattcagcgccaaaggtttcggagagtataaaccggccgtgtcgaacaaaaccgccgaagggcgcagcaaaaacaggcgcgtcgaggtattgatacagcctagaaacgccgcgactgaccaaaatcagtaatataaaaaaggaagcctttcaaatggcttccttttttatttctgatgaaaatgtttagcgtttaaccccactcttttcagcatttccgtacacatttctatctcttcatcactcaacacactgatcatttctttaatttcgtcagcatgatcagggaaaatatcgtccaaaagacggattcccttttcggaaatctgtgcgaaagtcactcttctgtcagtcggcgaggcttttctgatgagaagttcttttttctctaatttgtcaacaacgtatgtaatacttccgctcgctaataaaattttgtcgccgatctgctgaagcggctggttgcctttgtggtacagcagctcaagcaccgcaaattccgtcgggttcaggccgtgcttatgaatatgtttattcatatggtcgttaatagatcggtacgcacgtgacagtacaataaataatttcaatgagttttctgttttatccgtcatacattcaatcatccttttacaaaagaaaccgttacagagaaacattaataaacaaaatgaaaaatgtcaacaaaaatgtttccaaaatttctcttctttttgtcagaccttaataaaataatttgtttttctatcattttggttattttttcttattaaagaagtataaaaatgatataatacctctattcaagtgtaatgttggagcgatgcagagtgaatacatttaaaggtgcccggggaaagatcaagctttatctcatattggtgatcatcccggcacttattatcagctttttcatttatgaaaaagaaaagcagaaaatagccgataaacacatacaggaagccagtatgatgctcaaccttcaccgcaataagctcaattatttaatcggtgaaacaaaagcccggatgacaacacttgcgatcgctgtcgataagcctgtcaatgaagaaaagatcattgacattctcgatcaggcttttgaggatgaacccagattcagcggtctgtatatgctgaattccaaaggtgatgtcatcgcaagcacgactgatctgaaatcaaaggtgaatttggccgacagaccgtattttacgaaggcgaaaaagacgaaaaaaacggtcatcacaaatgactactccagcagaattacaggccagcgcatcttcacgatctgcgtgccggtgttagacgcaaaacgggaagtcacggattatttagtagccgccatacaagtcgattatttgagaaatatgatcaatatgctgagccctgacgtttatgtcaaggcaaccaatcagaataaagtgatatttgccagcggacgggctgatcaatcagaaggtgtgaaaccggtcagcggctatctggatgatattaattggaatatcaatgtttatccgaaaccggttgagctgaatgagctgaccaaaagcgtgctgctgccgatgtccagtattgccgtgctgctgaatattctgttcatcctcgttcaatattatttgcttaagcgcaagacccagctggagcgcgctcaaaatgaagcgcagaaattggagcttatcggaacgcttgccgccagcaccgcccatgaaatccgcaacccgcttacagggatcagcggcttcattcagcttttgcagaaaaaatacaaatcggaggaagatcagctgtatttctcaattattgagcaggagattaaacggatcaatcagattgtcagtgagtttttagtgcttggaaaacctactgctgaacggttggaagtgaactcgctgcaggatattcttgatgagattatgccgattatttattctgaagggaatctatacaatgtggaagtgaatgtggagattctcgtcaatcggccgctcaaggtcaactgcacgaaagaccatattaaacaggtgattttaaatgtcgcgaaaaacgcgctggaatccatgcaggaaggcggccggctgtccatctatttagaagcccgcgatcataaagcagtcattaaggtggccgacaacggaatgggcatttctgaagatatgcttgagcacatttttcttccgtttgtaacgtcaaaggaaaaaggcaccggcctcggccttgtcgtatgtaaacgaatcatgctgatgtacggcggttcgattgacattcaaagcgaagtcgataagggcacagaggtcaccattaccctccctgccgcttctcgatgaaaaaaacaccctgatcggggtgttttttatttaaagaagagtatgtgtaagaggatataccagaggaacggcatcatagccggcagatagtacgaggcgcttcgtgagccgtgccagcggaaaaatgtgctgactgtacgcggtcatctttcggatgcggcgcttgatcaggaagcgcattcagtcttcgttatctgttttatcatccatcatttgtttgcttcatatgcaggcatgacgtcaccgcgggagaacaagcctattttcttcacaaggccctgtattccttggtgatgtgtacgatcacggtttaccagctgctgatacgcgttcatcagacagtccagttcctggctgtgcctgatcgtgtcatatcctgtaaacccttgcctgttagccgcatctatcatcatttttctttttttatcaatagatagaagcaatttttcttgttcagaataactgcccattcacttcacccctcaccgctaaaagaataggaaacaagtttgattgggttattgagcattattacagattatactttatttgtaaacatttttttactaaataacttattttttcatttcatattggaatctttagcatgaataagagaataatacccattcgggtaatgatataaacagaatgcggcatattcaagaattaaaaaacagccaaagctgactttatattacaataaaaaacctctcatgccggtgggtgcatgagaggttcgggcgtctatcagttttgcacactttcattttcgtaaatcggcacccagccctcagtcgtcacgaagattcggattgcgacgacccggcggtcttcctgaagcgtaaagtagtggcggatgttctccggaactgaaatcaaatctcccggatttaaacggacgtcgaaaaatgtgccgtctttgccttgaatgacgaagatgccgtgtccgctgacgataaagcggacttcatcatccgtgtggtgatgttctctttggaaattttttaataattcatcaagattcggcgtggtgtctgataaagaaatgacatcctgagactgatatccgcgccgggctgaaatgtcctgaatctccgtgtcaaacgccgcgagaatccgttctttttcatcttcggttagatcgtatttttccgaaagctcagacggaagtttttcaatgttccactgctcatagatcacctcttgttcgtctaagaagcgcgctacttcttcctgatgttcaatgagcgtatttttttcgtcatgaattctgatggtcgccattttctattcctccttttattttaccagctgcggccgaagtgacagaagcttgaggtgacagctgaataaaaattcataggcttccagcacccttttcgcttcaaatgcggtccgcccccatgccgtaatgccgtgattgcggattaacaccgcgcctgagccggcggccgcatggtgcgcgaagttttcggccaatgccgggatgtgcgccggattgtcaatgatcggaacggtcacggacgcgttttcctcccataatccgagcgccttaatcatctcctgcccctgaaaagtgatttgtttttcatccccgtaaagctctgagatgacattattattgacggtatggacatgcagacagcagccggcgtctgtcttttggtataagtaagtatggagaagcgtttccgctgaaggttttaaagaatggccggtctcagcgggcttcccgtactcatcgattaagagaaaatcttcgtctgtttcttttcgtttgtcttttccgctcgccgtaacgagaaaagtcagcggcccgtcggatactttgatggaaagattcccgctcgttgccgggaaccagtctctttcagccagctcgcgttttacctcggcaagttcgcgccagcgttcttcttttgcagccatgcctgcacctccccgatgttttcaatgcctgttttcacctcatgaaaatcttgaaaaggcagatgccggaggccgagttctttgcattcagtcaaaagataatctctcgcaaagcacatatcggacaactttgcagcctcgacatccgtgaccgaatcaccgatcataatgagaaacttctgctgatcggatagcttacggatgactgacggtttgcagcagccgcattgattggtacagtctccgtcacaggcgtgcggccagtctatatgaatatgctcattgtcaaaggatgcatgattgcagaaaatccgctccttttctacgatcccttccaaaagcggatgcacaaaaaagtccattcccccgcttacgatataaaacgggaggccgtttgaccggacaaacgagacaaaatccaaaaagccgtcccgtattttcgcatccttcagaataaagccggtcagttcttcttttaagctgctcggcagcagtccgaacatccggccgactccttcttggattgatatgcttttagacagaacaccgtcttttaattcaagccactcaggaggcgcgaattctttcatcatgctgacaatgttgtcgttcatggtgaccgttccgtcgaaatcacaaataatcagcggtgtgcgggtcatacggcttccacccttccccatttgtctaatgcgagctgaagatctttgcacgacgcggctttttcttcaatcggctgcgcttcaagcaccgcatcaatgatggcgcggaacgcttttcccccgccctcggctcctttcggatggccgtgaatgcctccgccggcattgatgatgtgatcgatgccgaaatcgcgcatcaataatggcaccataccggggtgaatgcctgctgacgggacggcaaacgacggatgaaagacatcgtcttttacacattcatcatggattgcaagcgcggactccttcggaagagcaacggatccgtaaggtgacggaaataaactgaaatcagcgccgcaatagcggttcagcttgccgagcaaaagcgcatgcgacaagccgtaaacgggagatgatgtgaacgcgccgctgactgccggatgcgccatgatcggaagcgggatttccctgtcctcagcaaggctctgcatcacatctaaaccgtaagcaaacacattcaataaaagcgcgtccgccccgagttctgccgcgcgcctcgctttatcccgcaattcagcggtccttcccgtaaggtttacggcatacagcgttttatgccccgtttcctcccgggtttccttcaggacttgttttccttcgataatgcgggtttcaaacggagccagttcattttcaaagaaaatttcgtcatctttaataagatccacgccgccgagcgcctgctgtctgagctgttctttaatgtcggcgagatcccgtccgatcacgcctttaaatatgctcatcagaagcggtctttcaaattcgcccagcagtttgcggatgccgtatataccgaatttcggcccgggaagggagcgtttaaacccttcggaaaattcaagatcagtcaattttatttttccgtccagtgacagctttccgaataccgtcgtcaggacggccggaatatctcttgaaaaattcgcctcgggataggcgatggtgatgacggattgtgtttcgttttctgaggttccttctttctcctcaacttttacgacccgccctttatgttttctgagctgttcctgcttcaccaggggcaggtcagtccaggagcctaccgtcagccccgccgcaatctgttccgcccgcttttcactgtccgttgtgtctgtcagaagatatgttgccaatacttcgctcatgcgtgaacgcctctctttctttcgcaaaacataaaaaaacctcttccgtatgagcagaaagaggcttcgtgttatgtccgaatcttatctctcagctcctgctgcaagaattagcaccgtgctttatcagtcggttgccgggcttcatcgggctcgtccctctgcctgctcttgataagaataatgattttataaagtattttgaattatcgcattgttatcctgatatgtcaatgctttttcgggtgaaaagattcagtttcccgatcctttccgcagcttctttaagtctttcttcacttgtcagaagaccgactcttatatagccttccccccattttccgaacccgtttccggcagcgaccgcgacatccgctttctcgagcagcaggtctgaaaacgactgtgacgtataaccgtcaggcacagggagccatgcaaaaaaggagcccgccggagccgtcacatcccagccgatatcgcggcaggctttaatccatgcattgcgtctcgattcatatctgtcattttgcgccgcgacgcatgcctgatccgctaaaagtgcggctgccgccgcctgctgcgccgcgggaaacaggctgacaaacatatgatcctgataaaggttgatcgcttcgatgacagaagcgtttccgacggcaaatccgacccgccagcccgccatattatacgttttggacaaggtatagatttcgattcccgtctcttttgcgccttcggtctgcaaaaagctcagcggtttatgcccgtcaaagccgacggctccgtacgcgaaatcatgaacgacacaaatgccgttttgctccgcaaaaccgaccgtctcctcgaaaaacgcctctgtcgccacagcgccggtcggattattcggataattgagatacagcagcttcgcctcgctccgcaccttttcaggaattacgctgtaatcagggagaaaccctctttcttccgtcagcggcatcatttccattctcgcttttgcaagggcgacgcctgaccagtaatcaggatatccgggatcaggcaccagaatggtatctcccgggtttaaaagacattgcggaagctcaacaagtcccgccttgcctccgaacagcacggcgacttccgtttccggatcaagcgtgaccccgtactccctttcataaaatgcagcggctgcttctttgaagctgtaagcgccccggaatgatgagtatttatgattttccggcctttcgacggcgcgcttcatttcttcaacgatatgctgaggcgtcggctgatcagggtttccctgccctaaattgatgacgtctctgccttctttcagcttttgattcactttttgcaccaatgatgcgaaaaattgttccggcagctgtttgagtacatctgagatttcaaagttcatattttcaccttctaaaaatgtcttgaaatgatagtccatcatcatatatggttaaataaaaaaagtaaagagaaacttgaggtgttaaaaaatgaaatggaccgtttcctgtttgcaatttgatatttcatacggaaatccttcagaaaactttaaaaaagcagaatctttgattgagcaagaaagccgccatgcggatgtaatcgtgcttcctgagttgtggacgaccggctatgatctcacacggctagaccagctggcggatgaaaacggcaaagtttcggaacaatggcttaaagaaacggcaaaaacatacaacgtacacctcgttgccggatcttttgcggtcaaagaaggcgaaaatgtctataacaccatgtacatcgccgataacagcggacagatcgtgaagcggtatcagaaagcccatctgtttcagctgatggatgaacacctttacttgtcagcaggaaacagcgacggttcctttgagcttgacggtgtcaagtgcgccggactgatctgctatgatatccgtttccccgaatggatcagaaagcatacgtcccagggcgcgaatgtcctgtttatctctgcggaatggcctctgccccgccttgatcattggcgaagcctgcttatcgccagagcaattgaaaaccaatgttttgtcgcagcctctaactgcacggggtccaatcccgataatgaatttgccggccacagcctgattattgacccgtggggccggattttagccgaaggagaccggacggaaggcgcagtccgggcggaaatcgatgtgtcagaaagcgcggccgtgcggggaaccattccggttttccaagacttgcggcgtgatttatattaattttcaaaaaaatgttgacaagaatatccggcacctgctaatattttcatcaactgattaatccgaattgtgatacaaatcaatatatttttctcttatcgagagttgggcgagggattggccttttgaccccaacagcaaccgaccgtaattccattgtgaaatggggcgcgtacattttgcgccgagacgattgtctcataaggcacggtgctaattccatcagatgttatctgagagataagaggcggactgcactgtttcagcctccttctctttcagagaaggaggctttttttcgggcgtattctccgtcacgatctcttactgccactacataattggagggtaaatccatgtcagcaactaaaataagtctttatgaacaattaacagaaagctccgccgccgcgttagccgtcaagctcggcttattccaaagcaaaagcactctgacatgccgtgaaatcggcgacggcaatttaaattacgtctttcatgtttacgataaagaaaacaaaaaaggactgattatcaaacaggcgattccttacgcgaaagtcgtcggtgaaagctggccgcttacaattgacagggcgagaatcgaaagcagcgccctcatccgccagggcgaacacgtgccgcacctcgttccggccgtttactattccgatactgaaatggccgtcacggttatggaagacctctcgcatttgcggatttcaagaaaagggctgctggaagggaagcattatcccaacttatccgcccatatcggtgaatttttagggaaaacgctgttttactcatccgattatgcgcttgatgcgaaagtaaagcagcagctcgcaaagcagtttacaaatcctgagctttgcaatattacggaaaggcttgtgtttacagaaccgtttctcgaccatgagacaaacgattttgaagaggagctgcgcccatacgcagaaaaagtttggaacaattcccggctgaaagaaggtgctgacgaattgaaagccatctttctgaattccgcggaaacattggttcacggcgatctgcacacgggaagcatcttcgccgatgaacatgaaacaaaggtgattgaccccgagtttgctttcttcggaccgatcgggtttgacatcggccaatttatcgccaatctgctgttaaacgccctcagccgcgacggtgacgacagacagccgttatatgatcatactgccgccgtatgggatacatttgtgaaaacattcagtgaagcatgggagaaagactgcttgccttcccgcagacacctgctggaagacacactgaaaaacgcgtttgaggaagcggtcggttttgcgggatgcgaactgatccggcgcacgatcggactcgcccatgtggctgacttagatgaaatcactccgtttgacaaacgaatcgaacggaagaagctcgcgcttgacatcggcgcctattatatcgaaaacagaaaaaaactgaagcatatcaccgaggttctggaccaatttaagctccgtgtaaaggaatgatgcagcatgaccaatgaatttgccatcccccgttctgtagaatggaaagaaacctacatccgcattttaaatcagcaaaagcttcccgacgtcactgaatatgtggaacttgaaacaaaggaagatgtattcgacgcgattgtcacgctgaaagtaaggggcgccccggccatcggtataaccgcggcgttcggactcgcgctctccgccaagtcgtttgaagcccgcgacctttcggatttccgacgtcagttcgcggatgtcaaagcgtatttaaacagttcgaggcccactgccgtcaacctcgcgtgggcgcttgacagactgacggattccatcagggatgcgatctcaatcaatgaagcgaagacaacgctcgttcatgaagccattcaaattcagattgaggatgaagaaacatgccgaatgatcggccagaatgcgctgcacctttttaaaaaaggcgaccagatcatgaccatctgcaatgcgggctcgattgccacaagccgatacggtacggcgcttgctcccttttacttagcgaaacaaaaagatctcggccttcatatctacgcatgtgaaacaagacccgttctccaaggatcacggctgacggcgtgggagctgatgcagggcggaattgatgtcacgctcattaccgacagcatggccgcccatacaatgaaggaaaaacatatttctgcagtcattgtcggcgctgacagaattgcaaaaaacggtgatacggccaacaaaatcggaacgtacggcctcgctattttggcaaacgcctttcaaattccgttttttgtggccgcaccgctttcgacatttgacttgcagattgaaaacggctatcagattccgattgaagagagagatccggatgaagtcagacagatctccggcatacgcaccgctcccgaagatgtgccggtcttcaatccggcctttgacatcacaccgggcagcctgatttccggcattataaccgagaaaggaattgtgaccggctcttacacggaagaaattgaacaattattcactgactgccagctgagctgaaaaaccgctgatgatattgcctcaggcaatgtcagcggtttttttgtctgcacaatgtaatcacttcatctttttggacggctgtaatgagatgcattttaaaaaacagctctgcataaccggctatcttttgcggacggctcattttcatcaggcttcgtcctcctttttcatcagaccaacttttttcacttaataaaatgatatgtcggacgtgaaaaaacggaacgtgccatacgctttatttttctttataggatatttgttcgatgttcaacagcaccgcttttacatccgtcttcgtgcccgcgtatcccgttaaggcgctgtttttgccgattacccgatggcaagggatcaaaatcggcagccggtttcgtttattggcttgtccgatggcgcgcaccgctttcggttttccgatcgcttcagccatatcgccgtagcttcgggattccccgtaaggaatcatcgtcagcgcgttccataccctttcctgaaagggtgtgcctttttgtctcagaggcagagagaattgctttctttctcctgaaaaatatgatgccagctgctgtttcgcctccgacagcaaagcggtttcgcacggctttacgccgggcgcgtctttccgccattcctcaaaatcttccccggtgagaaacaggccggtaataaagctctcttcctctgttatgatgacggttccaaacggcgctctcacacttgtaaaacagatcattccccgctccttctttcttcggtattctgccggatcggaagcgtcaaatgaaaaacggtgcccttcccttcttcactttccacatgaatgcgtccctgatgttcttcgatgattttatagctgaccatgagaccgaggcccgttcccctgtcttttgtcgtgtaaaatggttcacccagacgttttaatttgtcttcggaaatgcctgttccttcatcttgaatagaaatcaaaatgtggtcttgatcagaagactgaatggtcacgtagatattgccgccgcccggcatgacttcaatggcgttttttaaaatattgataaacacctgttttaattgattcggttcacagtaaatcggcgggatgtttccggtcaggttcagatggatctgcacattgacaagattggcctgggcattcaaaagatcagccgtgtctttcataatctgcgtcacgtctttttcttcatataatatcgcctggggtttcgctaaaattaaaaattcagtgatgatagactcgattcgttttaattctgaggtaatgacgttaaagtacagagaatattcgccttcaatgcttccttgaagaagctgaatgaaccctttcagcgccgtcatcgggtttctgatttcgtgggcgatgcccgccgccagctcccctacaacatgaagagtgtcggatttccgcagcctctcttcaagctctttggcctctgtgacatctttaaagatggccagattcatattttgaatgatatttcttttgaaggagaattccagtttgcggctgtcgctgctgcttaacaggaaggggatttcattatccattccttctaaatcaatctttctggcgggaacacccgcgttttcaatatcaaataaagaaagaatatccggaacggtgtacgctctcagctcctcatccggcataccgagtatacggcttgcgagaggattcgcgtcaataatgcggaattggttgtcaaataagaccttgccgtccattgagccgttgaatacttttctgaatttcagctcgctttcccgcaattccttttccatccgcttacgatcgctgacatttcttaaaatggttaaatgctgaccttcaagtatggttcgttttgatgtgaattccagctctttaaattggccgtttgccatctgaaacagcatttcttcacggatttccccgtatttttcatattttttcttaatctgtttgtattttttctgcggatcaacgataaacgtacataaattcgtctccaccagtttatccatcggcagttcgaaaatgcggcacgccgattcgtttgctttggcaatctttccgtcatcagaccaaatgacaatcgcgtccatggcgttttcaaaaatttcgcggaatcgctcttcgcttttgaaaagtttcaattccatcaaccgtttctctgttatgtccctcataatggacatgtagaacccgctgattaagttggacgtaatcgtaaattcaaacagcttctcttcgcccgaccgaagcttgacgggcagttctcctttggcgtttccttttctgcggagggtttcccagatttctttcagatgctttttgttttctccgtcggtaaaatggcggagcgacagatgggacaattcattctggccgatctcaaagcttttgcaaaaagagaggttcgcatcaataaacccgccgtccttatcaaacagcacgatgccgtcgacagccctgtcaaacaaatctttaaacagctgctcgttcatggagaattcgcgctctaatatttttttagaggagatgtccctcatcaccacaaaaaaataatcctccccaattccgtctctggcgaggaattcaatgtatttcgtcgcgccgctgtcaagcttaatcggcacctctttccacagatggcctttttttaaaaactttttcacggccttattcagttcttcctgaggcacggaatataaaaaatccaggacggagcggttaatgaggttctctgcctcaatctgcatcatccgggccgcagcctcgttcgcctggacgattttcatttccttacggcatataaaaatggcatcaagcgtgttattcataatcacgtgataccggttcaaatcactcttcaggcggtcattttcctctttcatccgcttcagctgctctttcagcgactcgtttgtttgcaaatccagagtttcagccattcagtacactccttcttcaaaaacctatccttcaatatttctacaaaatacctcatcttccttcattcgccctatacatttcagaaaatttcaatgatatgacaagttaaagtctttttctacgatccttacctccccattacatcatcctaacaatcccttttgtcctccttcaattttttgttttttattttaaaatgaacaccaacaggaaataatcatgcagtggatgatttttgaagagaaggtgatgctatgacaaaatcgcgagacagttactttgacaacgccaagtttatcttgatttttctggtggtgttcggccatatcctccggtcatttattaacggaaatgagtttatgctccacctctacaaattcatttatacttttcatatgccggcctttatcctggtttccggctatttcgcaaaaaactttaagcggaaaggttatgtgaagaagctggctgtgaagctgattattccgtacctgatttttcagggcatttactcagttttttactatttgattcaggatgaaagcatggcaagcgtcaatccgattgatccgcagtggtctctctggtttttagtcagcttattcttttggaatctgctgctttacccctttacgaagctgccgaaaatgtgggcgcttggggcgagctgctggcttgccgtcatgatcgggtatcttgattttatcagcagcacgctgagtctttcacggacgtttgtttttctaccgatgtttctcgtcgggttttatttaaagaaacggcactttgatttgcttcgggctaaaagaggcaggcagattgccgcgggcgtactggggattgttttcctcttatgctggtgtattgattttgattactcgtggctgttcggatcggagccttattctacattcggcacagtgtcgctgttgagcggtctgtcgcgcatcggctggtatgttttggcctttgccgccactttcagctttttggcgctcgttccgcaaaagcgttatttctttacgaaatggggtacgagaacgttttacgtgtatctgctgcatggattcattataaaaacgctgcggcagatcgggcttgaagatcacttatctgattatcagaatttagtcatgctcttaattttaacggccgctcttacgtccattctctccagcaatgcggtgaaaacggccgcacagccgtttattgagctgcggatcaccggctggcttgaagcggtgaaaggaacaagaaacagtgcttattcgaaataatgcaaaatacctcttaagcgttatcgcctaagaggtattttttattgtttgccgtcttcttttttctttggcttcgtctgttcaagcgtttcaatccattttccggcgttataatcaccgagctcgcttgcaaactcttcttcaagcaatttagggtccatcggctttttatggttttgcatgtctttgctgtggcggttttttttcgtcatgttactcgcctccttgtttgccgtgttttgatttgcggtttgcgcctctcagtccgggatcaccgtcatattgtgttttatatgcatctttgtccatgctctcagtcggtgtgttgttgttcgtcaaagcttcattctttgctgctttgcgtttcatttgatttcctccttctgtcagcaaatctgttttgaattcatcaagcatttttttcaagtcgcgcactgtcacgtttttggcctcatcaaggagctcatagccgatctgtccgttcggctcaagcagcacatatttaaaatcttgaatgtctccgaggccttcctgcctgatcctcattgacagctgagattcggtaaaacgcattttttttaagttttccgggatgacttttccgtttctgacaacggcgacggtttttcctgaaaataaaaactcaaaaaagcttgatttgatttctaaatattccatcaggattaataccgcaataaaaatcgccgccgcgaaaatagtttcccataaattatgttcaataaacggctgaataataatcgagccgatcgaaatcatgatgactgtctgggtcaccgacagctggctgattgatttccgtccggcaatccgcaataaaaaggtaccgaccgctatcataactaccgacttccaaaatacggtaaacaatgacgtcacctctttacaagtagaatctccaaagaaactgtttccactcatccattttacggcaataaaaaacaccgctttctgaaaagcggtgtcagccgataatcattctttccttcggatagtgataatttgcttcgatttcttttcggccgatcagataaaggaacgtcaaaatgccgatccggccgataaacatgacaatcatgatgacgcattttccgatgtcgcttaaatgcggagtaatcccaagcgacaggccggtcgttccgaatgcggaacacacttcaaaaagcagtccgaggagcgtctgatttttctcggtcacggccagaatcagcgtcgatccgaacacgagcagaatcgccatcatcgtaacgaccagcgacttcatgacatcagcctggtgaagctcgcgtttaaagaccttgaccgctttatttccccgggcaaaatgaaacagggcaagaaggttaagcgcaaacgtcgtcgtacggattccgccgccgaccgagctcggtgatgcgccgatgaacatgagggcgcagatgaaaaataatgtcggcgccgacagctggctgatatcaattgtcgcaagcccgccgcttcgcgtagcggttgattgaaagagacataaaaataaaacatcatgccagcttttccccttcatgacatggcttgcttcaagcgcataaatgcccacggctccgaacaaaacgagcattccgaacgtaacggtcgtaattttcgtaaacagcgtgaatgagtatctgcgctgttttgaaaacaaaaagtcctttacttctacgagcaccggaaaaccgatcgcaccgaaaataatcagaagcatcgtaataaactgcacgaaatagtcatgtctgaacgggacgagtgaatttcctgtaatatcaaaaccgccgtttgtcgtggcgctgacgctcgcaaagaatccgtgcaagtacgcctgttcaaacgaatcataatacgttaaaaaatatgttcctaagatgatgccgcctaaaaactcgattaataaaatcaaaaacagcacttgcttcatcaggttgacgataccggaaaactgcgattgattctgatccaccatgatgagcttccgttcccgcagaccgatccgtttgcccataatgagccagacgaatgttccgagcgtcatgatgccgattccgccgaattgaagcacgaaagccaaaatgacaatcccggccgtgctgaatgtatcagccgtgttgacgaccgttaaaccggtgacactgactgagctgacagccgtaaacagcgcgtctataaacgaccagctggccccttgtttgtgggcggccggcagacttagcaaaataaatgccaccgtcacagcgagaaaataatataatgcaatcagctgtgcaggcgacaagatctgtatgaatttcttcagttttaatttcataagatagttccttctgcctctcaaatgtagtacgtaattattctaatgatattgggagaatttttaaaggtctttttagaaagatttttcattaccttatgtaatttgccgatctttaaacaaaaaacctctgaaacgattgtcagaggttttgttgattattttgcttccagcctgcggatgcgctcatcgagatcagggtgtgtggagaacagtgacgaatgctttttaccgttaatttttaacgtctgcaccgccgtctggtcctcttcattcacatgtcctgtataagacttcagcgtacgcagggcgtgaatcattttatccttgccggcaaggtctgcaccgccgcggtcagcgtgaaactctctatggcgcgagtaggcgaagacgacaagactgccgagaatggaaaagataatctgaaacacgatcatcgcgataaaatgaacgaccggcgcgaggtcttctttgacaaagcggcttgcaacccatgccgcgattcgggaaaggaatacaacgaacgtattgacgattccctgcagcagcgtcatcgtgaccatatcaccgtttgtgatgtgtgcgacttcatgggcaagaaccccttccaccgcagcatcatccatctgctgcaataaacctgaagaaaccgcgacaagcgaacggcgcttagaaggtccggtcgcaaaagcattgacctccggggaatgataaatgccgacttcaggcattttcgtcatccctgcggcacgggacaatctgtgcacacggtcaaccaattgttgttcttcatagctgagcgactgtttcttcggatttaacacccggacgcccatcatcgttttggccatccatctggacattccgagagaaataaaagaaccgacaaaaccgacgacaagactgaacacgagcaatgccatcagatcaatgcggccattttgtatatacgagccgacaccggtaacgcttgtaataatcgtaagcacaattccgattgtcgtaatgaccaaaaggttcgttaaaataaacagaaatattcttttcgccataattacctccgtcttttttaagatcaaaagaacttatttacttaaattataaatgatctgtttgaaaatgcaacaatttcgacgtatgatgttaatgtaattctcagtgatattaaaaagtgaacacgtaatcaatcagaggtgaaccatgaacacgtttaaactgacccgaactgatatggtccggcttctttacgcgctaaaaggccaaggagacgcaacccctctccaaatcttattgcaatcagcggatatgaccttggatgaggcggaaagccgtctgcatatccctgaatttctgacgagattcgaacgaaaaaaagagaaaaaggaatacgggctttcaactaacgagattgtcgagctgggaaatctgtgcgagctgacgtctttaaaatcaaccgccgtccaaaactgggtgaagcgcgatattaaagatttaatcggccaccccttactcggcaaaaaatatacaattgaacaagctgtcatccttctcattgtacgtgatttaaaatcaatttatgacttcgaacatatacgcggcatattaaaaatcgcttttaacacgatcacagacagatcagacgacgtcatcagcccgatcagctactatgaaagctgcgcccaagtgattgattatcttcatcataaggcaaacccgccgatgaaggaaacgagcctgcaggagctcgtcgaagagcagacggacaagctcaaaggctgctttaaagaactcggaagcggacaatggaacaatatcagatccataatcgccgtcacggtgctctccgttttgactttccatattcaagcctcagcctacaaaatgaccagccatttattataattcataatgcttcttcgccccggtgtctgcgccgggttttttttgctgtacaacaattgccagcataatcaataccgttccgtttgaaactaaaacgcgaaaacacatcttgccagagaaaaggagatgaaaaagatggcgagcagaaataaactcttagttccaggggctgagcaggcacttgaccaatttaaatacgaagtggctcaagaattcggcgtgaaccttagctctgatacagcagcacgcgcaaacggctctgtaggcggggaaatgacaaaacgtcttgtacagcaggctcaatcacaattaaacgggaaaaatcaataatgcagcttattcgccggggcttctcggcgaattttgatatttatcggcattctcctttccgtgccggtagccgttcggattccttcggtctgacgaatcttcatgatgccgataggattcccaatgttcattgcgatcatgattccagtaatgattgtaatacttttgcttaggctctttgtcatttccgttttcctgaggattttgtgttgggggctgctctgtttccccatcttgttccttctgtgtgttttcctctgatccggaagctgcatttttttcggtttgctgattgccgtcctgactgtccggcttcgcttcttccgtaccgggcgttgtttcattgtttcccggcttctctgctgccttttcttcatcaggagctgtcttttcatcagccgccggcttgtctgtgtccggctgctcgctttgatcagcgtctgtttcggtatctttttgatctgtttcattgccgtcggtttgcttttcaggctgtttttcttctgttttcttttcgtttcttcttatgtagctgcctgttgacatcccttcctgttttgctttttctcttgtttccatatcagattcaagcgattggacctggtaggtgcccttatatttttcagtcatgtcagccagctgttttttaacgccttttttatatgtattgtcatctgtattttcataaaccgtggaaattaaaatctcttttgattcctttacatatccatgcttgctgcaatcggtaataatattactgatgacttccttaaaatcgctgcttttccaatctccgatgtcactgatgacctgtttggcgtcatggttcagcggtgtcagttcaatgacttcatatttgctgtttaaagccatttcaatgctgggattaatgtcaagcgtcatatacgcgtaagctttgttatcagaaaaaaccgggagcaaaattaaaataaacaaaataatagcagtcatcgtaaacactcccaatttaaaagggcgcagtttcagaaaatcaaaaaagctggcccttcttcccatacgcgtttcgccttcgaacgtaatttcctctccgatttcacaagtgcggtgatcattttttgtttttaaaaattgtccgtcaggggttagcaacgtgacgaattttttatttttctctactatgatccctcttctcatgagtgcaacacccctttaagataatcttttaaataaatataatcaccggtaataataatactcatggcgatgatatattttcggttccgttcgatcgtttttctgctgaccgacacgagctgctccagctgtttgacaggaagctgttttttctggtgcaaaatggacgccagctcttcattttcaacaagcgtgtaggcaaccttaatcgcattctgcctcgcatctgtatgcttcggcgattgttccagcagctctttaaaagacaggccgtattctttcagctgcttctgaaaaaaaagaatttcttcccggcgctgttcctgttctatctgtttgcggtattcatcaatggaaagctccgcttcgataaggctctgcgaagattcctggtcgtcgccttcctgcacatccatattgatatgctgagcggttcttgcttcttttctgatatagtctatcacttttctttttataatcagctctgcaaatgcaagcagcgaattacctttttcagccgaatatttttcaatggcttcgttaaacgcgatcagcccgatgctgaattcgtcgtctttttcatctatatatcgtttacaaacggatgaaaccgtcttcgcgataaaaggcttatattgctgtattaaatcgttctgcagatctttgtcgcctttttgtattttttcaacagatgtttcaagcgtttgcttcttttttcccaatttaaacaaaaggctaagcactggtttcacctcagttcctccctataactactcataatcatagctaatttagtagggattcgcaaaggaagaaaaagagaaatcgatttcatttgtctcaattatgacaagccaataagacgtactatacatgatttcgtgcccccatgcagaattaagggggttttctctgtgttttttgtaacaatgctgttataaaattgttatcatatgtcttaaatgtaagcgtttcaaacaaaaaagggaacctgctttttaaaaagccagactccctttttgatcattttacgcgtgttctcttttttccgattccgcgccggactctatttgttttgctcctgacataaaccatccgcaaaccgcaatggcagccagaaccgcccagaaaatgattttccaggccgccgaatggatgatatctgccggaattataccgagttcctcatgggccaatgtataaagagcgagcttcacgcctacccatccgacaatcacaaatgccgccgtttcaaggcccggcctggttttcagtaaggatacgaacattgatgccgcaaaacgcataatgattaaaccaattacgccgccggctaaaataacgagaaactgaccgccgtccaagccgccgatggcaggaagctgagttcccgggagcgttacggcaagcgcgaccgccgctaaaatggaatcaacggcaaaagcgatgtccgcgagctccactttcaagacagtctgccaaaacccgctttctttctgcgttttctgaccggcgttatctttaaatacataccgcttcagcaaatggctgaccgcaatgtaaaacagatataaagcgccgacggcctggacctgccaaacattcaccagaaaagaaatggcgaacagcgacccgaaacgcaaaataaatgcgcccgccaatccgtaaaataaagccttcttcctttgtttttcaggaagatgcttcaccatcacagccatcaccagcgcgttatccgccgccaaaatcccttccagcccgattaaaacgagaagaacccatccatactccaataataatgcaaagtccaatccattccctccgtttcttttttctatcatccgagcttataccggcggttttttacgcaaaaaagacctttgccgatataaggcaaaggtcttgctagacatgaatgattggcatgccaacaaagccgatggatatgatccatgaattgacgactttgtttccggaatatccggacgctactcccctttgggatttcaagaaatatttgtttatacgctcatgataaagcctgtttcatcatttgtcaacgcttaacttttttaacaaattgagaaattttttctgttttggcccgctgttttcttctctttaaaaacatccaaagaatgagaagcaacacaatgaatataccgagcggcagcatatattgatcgagaatggaaccgacgcttttccaattttccccgagtttcattccgaggtatacgtaagcaaatgtaatcggcagcatcgctgcatatgtatatagagagaagacccagacattcatcttcgcaatgccgcacggcaaagaaatcagcgtcctgacccccggtataaaacggccgctgaacgcgaccaaacctccgtgcttctgaaagaaatcatctgatttctgcagggattcgggttttatccatatatactttccatatttcagcaaaaacggccgaccgcccagcctgccgattccatataagacaagcggacctgaaacaccgccgagcgaaccggcaaacacggtcccggcaagcgtcatatccccttttgagacccaatagcccgcaagcggaagaacaatttccgccgggatgaattctatactgagcgccaaaaaaattccggcataagataagcttttaaacgcctctattattgatatgatgaaatcttcgatgatctatcactcccggcttacgtctatattccgaaacttaagaatgattttaacacaaaaccttgaggctgaaatatcttttagacatgcccgttataaatgtgagtcgtttcagatcggtatagcgggagggaatgacatgcgcaatacaacgtcccgcctgtctcctgattgcttgtctggcggcgtttacatcacttaagatctcccgaaaagtaagcggcggctgaccgcggattcagttcatatgggagcgggaaattttctcagtcaccacatgggaatgcgtgggcatttcccggggaatgattttgtataatctttttgattaccgctgatgattttcagggacttcagcgctttaaagaacttaccgattcactgattgtaaataaagaattcatttccttttcagccgaccatttccgcctgaggaaatggaacagccgctccatgaagcgccgcaacacccataagttgctacacatggaacggacccgtttatccacaataaagacaaaaaggagtttttattcatgcacacgatgtggaagggttcgatcagtttcggcctcgtcaatatcccggtcaagctctttgcggccactgaagataaagatataaaattccgcagtcttcataaagaagaccatgcgccgattaaatacgagaaaatctgcaccggatgtgaaaaaagtctggaacctgatgaaatcgtgaaaggctatgagtatgtaaaagggaaatacgtcattatgacagacgaagacttgaaagacgtaaaacaggaacatgaagaaaaagcggttgagattgttgactttgtccagctgcaggaaattgatccgatttattttaaccggtcatattatgtcgggccgggagataacggcacaaaagcctatacacttctgcgggaagcgctgaggacgacgggtaaaatcgggattgcctccattacgatccgctctaaacagcagcttgcgattcttcgcgtgtatgacaactgcatcgtgatggaatccattcattatccggatgaagtcagaaatgccggacatgtgccgggcgttcccgagcagacagccgttaatgaaaaagagctgcagacggcgattacgttaattaatgagctgacaaccgagtttgacccggaacaatacgaagatacgtaccggaaagcccttctcgctaaaattaacgataagctcgaacatgaaaaagcgggcgtgacaccggctgctgccggcccgcgcgaagatgtcatcgatcttgtcagcgcgcttcaggcaagcattgaccggacgaagcggccggatcgcgaacaggctgcaccggcgcggacaaaagacgccgcgtcagcaggcggcggaggcaaaaagcagaagacgaccagacaaaaagccggaacgtcttaatcatggtgctgacgatgcagccgattttgacctctgtaccgcctgaaggcagtgagtggcgctatgaggtaaagtatgacggattccgctgtcttctccgcatagacgaaagcggcgttacattaaccagcagaaacggacagacgctgacgaatcaatttccggaaatcacggcttttgcggctcggtgttttcagcacatgaaagacaggttccccattacgcttgacggagagcttgtctatttaatcaatccgtacagagcggactttgagcatcttcaaatccgcggacgtttaaaacggacggaagcaattgaaagcaccgctgatagacggccgtgccgctttctggcatttgatctcctcgttctggaaggcgccggcaccgtctcattaccgtatgtgaaacggaaacgcgccctttccaaactgcttaaagaagcaaatcttcccgcctgccctcatcacttagcggaagaagcgattcaatacattccggaacacactgactttgatgcgctttgggacaaggtcgtccgccatgacggagaaggtatcgtagcaaaaagggcttccagcggctgggcggaaaataaacggtctcccgactggcaaaagtataaacatatgaaaacggcacatgtgctattaaccgggtttaatccgaagaacgggtatataacggcctctgttttaaaagacggcaccgccgtcccgatcgcttccgtttcccacggcatgcaggcggaagaaaaaaacgccgtcagaaccattatggagacccacggaaaaaaacaaaaaagcggcgagtatacacttgagccttctatctgcatgaccgtgcagtatttaaccatattgcaggacacgctgcgtgaagtatcttttgtgtcttttcagtttgaaatggattggacggaatgcacgtatcagcagcttatccttcactctaaaacgctgccgccgaagctgcagttcacaagcctggataagattgtttttaaaaaacgtgaaaaaacgaaagcagatttccttagttatatggtgaaaatgagcgattttcttatgccctttcttaaagatcgggccgtcacggtgatccgttatccgcacggcgcgcctggcgaatctttttttcaaaaaaacaaaccggactacacgccggactttgtctcaagcgtgtttgacgggagccacgagcacatcgtatgcagcagcataccgtcacttctatggctggccaatcagctggcgcttgaatttcacgttccgtttcagacagtgcattctgaaaggcccgcagaaatcgtcattgatcttgatcctccgtcaaggaatgattttcctatggcagtggaggctgcgcatgtgctgaaacagctgtttgactcattaagcattacgtcattcccgaagctctccggaaataaaggcattcagctctacatcccgctttcaccggaagcattcacctatgaagaaacccgtgcgttcacaatgctcatcgccgattattgcgtcaggacgcggccggatctttttacgacagagcggtttatcaaaaaccgaaacggcaggctctacctagattacttgcagcatgccgaagggaaaaccattatcgccccctattcgacccggggcaacgaattgggaacggttgcggctcccctttattggagtgaagtcaactcctctttaacacctgatgattatacgatcgatacagtagtgaaccgcgtcaggacagagggagatccgttttatgatttttaccggaatccgcaggacggcccgctttcaatcgtgcttgagcaaatcaagagaaagagctgacgctttttgtcagctcttttcagtctgatacgtgcacatcaatttttctttggaaataaataaatagcaggagtaaggaatgtttttgagggtgagctgttttgcagtaaagtataaaatcggaatatgggccgctttcttaaacagcctgtagcagccgctggacggttttatcacatcaaaaccgagtctcgcagctcctttatgaagcattgtaatgccgacgactcccttaatctcgtctttccgtttatgctggttaatataatccgctaaatgaggcatggattgatataccttctgatatagcataatcccccttctgaccgcgctttcaataggctgcagctctttcaggagtttgacattatgaagatgaatcttaactaacacgtcgttttttttaattctggttccgtcgctcaggatgacttcttttcctttatatctagtcaaacggacgcggaatacattcgattgccgtttatcaatcagcgtcagccgggtaaagaagaaataaagcggatcaagtaagtaccatatagacagcagacagcttctcacatgttcaccttctttatattcaaagcaccctcatattttggcatggggcatgtcacattatgattggtaaataatgatgccgacctgtatcagcttatgcaaaaaccgcttcaggctctactgtccggaacagaaaaaaacactcttcgtgaagaagagtgtctgtatccgctttcttttaacggaaaagcaaatgctggctgtgaattcccgcttttttcagtaaggctatcagctgttcctgttcctcaggcataagtcctgaaaacgctctcgcaattctcaatgaatgaatcggataaattttatccaaatactcgtttcctttatcagttaaatgggcgtaaacagaccgtttgtccttagggtcttgttctctgaccaaaaacccgtttctttcaagcttgtcgatgacataggtgacattcccgctgacaagcaaaagacgcgacccgatttgctgaagcttttgcggacctctcgtatagagcagctccaaaacggcaaattcagtcggattaaaaccatgttctttactgtcgcggatgctgtgttcagacacacttttgaaagcccttgcaaaaactttgtacaaattcatcgaacgcatcacttcttcttcgttaaatgataatctcatcatatctaccccgtatttaagatttttataaaaaaataatgtaaacccttacaattcataagagtcgttctttgttttatattctattcgtgccgtttttcagaattccttcttttttatataaaaaaatacccttatacatcatttaatttgtataagggttccgttctttatagggaatgttccgaaaaaaatacgcgtattcctttctcagctccgtaattgtcatggaattgagtatttctttcgtatagactccgatctgcagaagctttttggaataatggtttctctctttgtccaatgcattttgaagcaaacgactcatagcggcctcctttgttttccgttattctatgatcagaataacgcttttatatcaaagacgtataaagccattgtaaaacttctgtagattatgatgtttttcggtaaagtccgttctggacggctctgagcagcggaaaagcgtgttccccggcaagctgcatgaacgcctccagcatttcatcgcgtttcatatctaattcaatgatttcttttgccagcgaaaccgctttttctttctccattcctatccttcctcctcattgtgtctgtacagtaagcataaaacggggcacagaaccatgcattaaccttgtcaatttttctgccgctttttttctaaaattttctattccgcgtcagaaaacctgacaagcgtcaggttttttctctttttttcttatataatatgagtaaaagacatccaggggtggaaaaatgacgacagacgaacaatcttacaaagataaaaaagtaatctcgatcggcattgtaagcgaattaaccggattgtcagtcagacagatcagatactatgaagaacggaaattaatctatccgcagcgttcatcacggggaacgagaaagtattccttcgcggacgttgagcggctgatggatattgccaacaagcgggaagacggcgtgcagacggctgaaattttaaaagacatgcgaaaaaaagaacaggctctcaaaaacgacccgcagctccgcaaaaaaatgctggaaggacagcttaatgctcattttaagtataaaaaccgctgatcaaaaaagtccgcctcctgtgagacggactttttttataaagcatgaagaaatgcagttgcaatgccgaaataaattaataaggacaaaatatcgttcagcgtcgtaatcagcggtcctgatgcaatcgccgggtcaatgttcagtttatgaagaataatagggacgatcgttccggccatcgtaccgataatcaacgttgcaagcagcgatgaaccgacgacaaaaccgagcgttaagtctttctgccagacggttgcgacaatcgtaatcgcgatcgcacagacgatgccgatatagataccggttcttaattcacggaaaatcagtttaaagatggtttttttattcatttcttctttagccagtcctctgatgacgacggcgagtgactgtgtgcctgtattacccgtcgttcccgcaatcatcggcatgaaaaacgcgagggcgacgactttttgcaatgtatcttcaaaataattcagaatgcttccggaaatcaatccgataaacaaaagcagaatgagccacggcaaacggcggtacgccgcaacgtacgctttcgtatcaaatgtaatcgccttaccggaggctgcgaatttttcgtaatcttcatcggcttctttaatcacgacgtcaataatatcatcgacagtgacaataccgacaagcacatgattttcttccacgatcggaatggctaaaaagtcataccgctggatcagccgggcgacttcttcctggtcttggagcaccccggccgagatgacacgcgtaaacatgagatcctgcactttatcctcaggctcgccgagaattaaatctctgtaagagagcactccgacaagctgcttgctgtcattaattacgtacaaataatttattgattctgcgatttctgcaaagcttttcagcttcacaaccgcatcttttactgtataatgctgcggaatccagacgaagcggttcgtcatcatccgtcccgccgattcttgcggatagttcatcaaaagctgcacggcctttgattcctcagcctccatgctggataaaagctgttctttcagttcttcatccatctcttccagcaatgcggcgagatcgtcgttatccattttattcattgcgagagtggctttcgttttaccgactttatgcaaaacggcaagctgaaattcccgctccagctctccgatcatgtcggtgatgtcatcaaccgtcatatatgacagatagcgggcccggtgcttttccggcatttctttaaacaaaaatgccatgtcatagggctgaagctcatctatcatgtttcggaattcttttatttttccgtcccgcaataaaatgataatgcgtaatatgagttcgtcataggtcatgttttggaccatcgggactcgtacctcctttacggagacgcgccgtccgtcaagggaagtgcggcggtttgtctcctcatcatgtcgtcactggttatctggctgtatatgggtacttcttctgacatactcgaatggggagaatccatactccgcacctccttatcatgctcagtcgtgtacgttttgaggcataaaaaaaaccttctgatatgaaggcgaaaacaagcacggcaaataaacgtgcggggcctccaatcgtagagctttagcactgtatggcataggacagccatccagctgcgttaagaatcaccttatgtcgatgattcctgttgacccattggcgtctttggacatttttgggcagcagcgtatctccatacaggagcctcacctaacgaagttcttatttgaattgacacactgagattacagaaaaaaaaggaatgtgtcaaccttaaatttgtgatttcagcacatgcctataaaataaacggaataaaggcataaagcccttattccggcaaatcgctttcatcctcttctgaaaggaaatgataggattcatgcagcatgagcgcgtactccccttcttttgtcggatgcggtacatactcagcctcgttgatatactgctcttcccttttcttcatatgacagacctcctgttcaattttagattgtccaaaagaagatccgttatcataggaaaaaaaattacttgcggagcgggacatgcagctatatttttcggatcgtgaaaaagttcctaagcagccacgggcccggtttgaaaccgagcgttaattgccacgcgccgatcgcctgcagtccgaactcccgaacgagaaccattttttcactcatgctccgcacatcctcaaaccacacttcatgcgttcttccattttcatcagtataccggaagtaaggggaacgctcctgctgggaataacggatcactgattgatgcttcatggccgtttccatggcgcgctgattggagatggcggatccgatcgttcccggacggtacggaatcacccaatcatacccgtatagcggaacaccgagaatcacttttcttctcggcaccctgctgatggcaaaattgatcgtttgcctgacctctgtcaaaggcgccacgggtcccggctcactgccggcgtggtgccagtcgtacgccataatgaacatataatcgacgacggctccgattccgccgtaatcatatcccctcagccacggcactgcatcacttgttttcgccggaaccgatatcgttaacgcgagctgatgctctgaaagccgggtttttaactgccggagaaatcctgtgaagaggtccctgtcagcttctctgacccgttcaaaatcaatatttacaccgccgtatccctttcttacggttaaggagacgatattgttgacgagattcgttcttgccgtcggattttgcagcacttgatgggctaattccggactgaatcccccttctgtcagattcgtaatgacggcaagcgggcgcactctgttctgccatgtggtttctattgcggttctgtcgtttaaatcgttaatgatatctccgttcgggccaaaatgatattcaaacaaagaaatcgccgaagaatacggcgcaaaatcattaattagctctctatccgcttcaggcgtccgaatgacataaaattgcagggttcccgcaagatagttagagatatcagggatcttcactttcatacccgcccgcagccggttcggcggaatatccgggtttgcctgcatcagctgcatctgcggcacataagccttacctgcgataacggcatacgtatcattcggctgaaccgtatattcattaagagggattaaaagcgcctgccccggaacgatattcgtttcctcaagcccattgacgcttctgatgctgtcaacagggtatccgtactttctgctgatggaaaataacgagtcaccagactgcactgtatgaacaaacatagatgtcctccgtttccttttgatcaaaagggctctacttatctttatgaatgatcatccggtccgattccaaactctgtttgaagaaaggctgtttacaaatcagacatgatcaactatgatgatgtcatcataaaaaactgtataggaaacgcactaggggtgctgttatcggctgagataaaacatgcggcaggcatgttttgatcccttataacccgatctggataataccagcgtggggaagtgcagattgaccggagcgcagggtttttccccatgcgttttcgttctgctgctgcatattccctcggatatgcagttttttatttttcattaaaaaacgggggaggacaccgcaatatgaaactgaatatgaaccgcctgtaaaatcatctctttcatacatacgactatccgataagaaagcaggagatcacaatgaaaaattggaaaatgagagaaattgtcgtcatgtccgtcatcagtgttgtatttgctgtcatttatttagtatcaactcatgcaagcaatatagcggcaggatttttcggccggatgagctacgaaccgatttacggtatctggtttatcgtctcggtgattgccgcgtacattattcaaaaaccgggagcggctctcgtttctgaaatcatcgccgcgtttgtggagtgcttactcggaaatccgtcaggaccgatggtgattctgatcgggatcgcacagggaatcggtgcggaagcggtcttttttgcgacacgctggcggatgtataccctgcccgtgcttcttttatccggtatgggttcttctgtgacgagcttcatttatgacttgttcgtttccggatactctgttttgaatccgggtttattagccgtcatgcttctcatccgtctggtctcaggtgcgcttcttgccggccttctcggcaaagcaatcagtgatgcgctggcttacacaggggtgctgaacggcatggcgctcggaaaacaattcaagaagaaaaagaaacaggtgaaccaagatgcaggcatctgagccccttctatcggccggccgtcttaccttttcttatgatcaggatgaaaagccgattcttcaaaacgtgtcctttcagctccgcaaaggagagcgggctttattgctcgggccgagcggatgcggcaaaagctcgctcgctctctgtttaaacggtctgtacccggaagcatgcgatggggttcaatcgggaaccgtttctttatacggaacacctctttcacatctgacagagcccgccgccagatccatcggcgtcgtgtttcaagatccggaccagcagttttgcatgctgacggttgaagatgaaatcgccttcggcctggaaaatttgcaatatacaaaagaagatatggacgcaatcatcgatgatgttttggcaaaattggagatcactcatctgaaaatgcgaacgatcgcttcgctgtcaggcggttcaaaacaaaaagtggcgcttgcctgtatcattgcgatggaaccggaactcattattttggacgaaccgacggcacagcttgatccatattccgcacgtgaattagtgcggctgatcaaagatcttcaagcaaaaaaaggcttcggccttctcgttatcgaacatcagcttgatcattgggctccgtggatggacaggacgattgtccttgacgaaacgggtcagaaggtgatggacggagagacggacgttatctttgaaacaaagattgaagagctgatgcagctcggcattccgattccgcgtgtgatctcattgcaggagcacgtcagcattccttttacattgtgtaaagaaaagctgtttcaagaatctgtaccgtctctgcccgaaccccggcccgccgcgctttcggcagaagacgcgctgagcgttcacgggctgtcattctcaagaggagcagacgtcatttttcaggatgtgagcttttccgtaaaaaaaggttcaatcaccgcgattgccggccctaacggaacaggaaaaacaacgctcctttctgccgcggccaagctcatccgtccgctgggcggagacatcaaaatagacggcagaccgattgattcctattctgaaaaagagctgcggcggctgatcggatatgttttccaaaatcctgaacaccagtttgtcacagattccgtcattcaagagctgatgttcggctttgaaagcagcagagccgcaaaggagaaagctcttcagctgttaacccgattcggcctgagacgccatgcctcacagcatccgttttctttaagccaaggacaaaaacgccggctcagcgtcgcaacgatgcttatgcacaatgtgaacgttttgatgcttgatgaaccgactttcggacaggatgccaaaacggcgcgggagtgtatgcaaatgctccgtgagattcaaaaggaaggaacggctgttttgatggtgacacacgatatggaactcgtctcagattatgccgacacgatccttgtgctctgcggcacgaaactggtattccgtggaactcccgacgctttgttttctgataacaccgggatcgccgagcaggcgcatttggctttgccgctgcggtatgaatggatgagacacgacaggaggcggagaaatgaacttgcggctggaggctgttaacccgtcaataaaggcggcggctgtattgttatgcgtcattatgctgtcgtttatttataatccgtacacccctgctttgttttatatcatcattgcgggaggcgtcctctcggcggggcgtgtgccgctgaaaaaatggctgctgttcacgattccgtttgtcattctggccttcggttctttatggacagccgccgtattcggaaacgtcccgacaaccggaagcaacctgctgtttaagctcgggccgattgccgtcaacagtgataacgcggcgctcgggatttctatcgcgtttcgtattttatgtttttccgctttgtcgatgatgtttcttttcacaaccgatccgattctgttcatgctcagtctgattcagcagtgtaagctgccgcccaagcttgcatacggcgttatcgcggggttccggtttctccctcttctgaaagatgaaatcctgatcatccggcaggcgcacagaatcaggggcgcggggtctgattccgggctgaaaggaaagctctccgccttcaggcgcttcaccattccgctattggcaggcgcaatcagaaaggcggaacgcacggcgatcgcgatggaatctaaaggctttacggggagccgaaaccgcacgttttacagaactgttaccgtgcgccgcgccgactggtgctttttcctgctcgtgcttctgttattcggcgcaagctggctcatttcattgttgtttgtataaaaacaggccgccggagtgattcggcagcctgttttgttatgtatgttattgatgataattgagagcctgagcgagattggacttgatcgtaatatctgagaaattaatgccgagctgtacggcggtttgagcgatttccggcctgattccggataaagtggacgtgacgccgatcaatttcagcgcctcaactaatttaaaaatctgatgcgccaccatcgtatcgacaaccactacacccgacaggtcaattaacagatgttcaatcagccgttttgcacatgtgctcagcgtattttcaagaatgaatttggcgcgctccgtgtcaatatcgccgacaagcggcagcagcgccgtccgtttgctcagcgtgataaccggcgagcttaactccaaaatcatttctctttgcgcattcagctgcatttttgagttatgctcggcatgatcgacaaacgtgtaaatcgtaaaatcaaatacttgtacaattaaattctcccatttcttcctttctccctgtgcaaacgaagattcatgtttatcggcaaacgcatcgtaataactgatgtatagtctccggtttctcatgaattcacggaccacatactgtacgggagtatccagatgcttctggtctttcgcaagctcaatcacccactgctcgaactcttctaaaaattcttttttcggcatgatatacattttattaatatgccggtaaaattctttatcctgctccgtcagttcttctgtgatgacgggatttgtcaaagaataaatcgaattcggatccgaatcttccatcgtttcgatccactctttcgcaatttgatccacttgttctgaaaaatagttgtataatgcttcacttatcttcatatctcttctcctttcccatttccaattataccgtcagcggatcatgaatgaaaataaaagctgttaaactatccatttatttgaaattttttagtgcgatagattacgccttttttatgaaaatgcttcaaatgactctttccggccggcatgctctgccataaaatagtagcaacacccttgtatccactcgcaagcataaaaaaggagggcttttttatgaatggtgaaatgcatttgattccttatgtcacggatgaacagatcatggaggtaaacgagcttccagagggtattaaagtgattaaggcgccagagttgtgggcaaaagggtttaaaggcaaggatattaaaatcgcggtgcttgacacaggctgcgacatcaatcatcctgatttgaaagaccggattgtcggcgggaaaaacttcaccgatgatgacgaaggcaaagaagacgcgatttccgattataacggacacgggacacacgtttccggaacgattgccgccaatgattcaaacggcggaatttcgggtgtcgcgccggaagcaagccttttaatcgttaaagttctcggcggtcaaaacggcagcggcaaatacgaatggatcattaacggcatcaactacgccgttgaacaaaaggccgatatcatttccatgtcactcggcgggccaagcgatgtgccagaattgaaagaagccgtcgcaaatgcggtaaaaagcggtgttctggtcgtttgcgcggcaggaaacgaaggcgacggagacgagcgtacagaggaactgtcgtatccggccgcttacaacgaagtgatcgcagtcggatcagtctcaatcgcccgtaaatcgtctgaattttcaaacgccaacaaagagattgacctggtggctccgggagaaaatattctctccacccttcccaaccataaatacgggaagctgacgggcacttcaatggccgccccgcatgtgagcggagcgcttgccttaataaaagggcttgaacaggacgcgtttcagcggacgctttctgaggctgaagtctacgcccagctcgtgcggcggacccttcctttggacatcgccaaaacattggccgggaacggatttctgtatttagacgcgcctgaagtactgatggaaagagccgaacaggcacagctgctgtctttctgatatttttctcatataatgattgatcagcttgtcatatcaccaatttttaaaatgtgagattttctattgacagtggtctgaataagctgataagataaccaacaaatgatgtaacttttcaaaaaaatttaaatattttctcttatcgagagttgggcgagggattggccttttgaccccaacagcaaccgaccgtaattccattgtgaaatggggcgcgtgatttttgcgccgagacgactgtctcataaggcacggtgctaattccatcagacgtgatctgagagataagagaggcttgcattttgaagttaaagcctctttctctcatgagaaagaggcttttttgttacatctcacttaaaggaggaaacttaatgacaacaatcaaaacttcgaacctcggttttccgagaatcggcttgaacagagaatggaaaaaagcgcttgaggcttattggaaaggaaacactgacaaagaaacgtttcttaaagaacttgacggtttattcttatcagctgtcaaaacacagcttgaccaacatatcgatatcgtgccggtctctgatttcacccattatgaccatgtgcttgataccgccgtcagctttaactggattccggaaagattccgcagcatcacggatcccgttgatacatactttgcgattgcccgcggtgtaaaagacgccgtttccagtgaaatgacgaaatggtttaataccaactaccattacatcgttcctgaatatgacgaaagcattgaattccgtctgacgagaaacaaacagcttgacgactaccgccggatcaaagaagaattcggagcggaaacaaaacctgtcatcgtcggtccgtacacattcgtcacacttgcgaaaggatacgaagaatcagaagcgaaagcgattcaaaagcgccttgttcctctttatgttcagctgctgaaagaacttgaagctgaaggcgtaaaatgggttcagatcgatgagccggcccttgtgacagcttcttctgaagacgtccgtgccgcaaaagaactctatgaagcgatcacaaaagagctttcaggactgaatgtcctcctgcagacatacttcgattcggttgatgcatatgaagaactcgtttcttatcctgtacagggaatcgggcttgacttcgtacatgataaaggcagaaaccttgagcagctgaaaaagcacggcttcccgaaagataaagtgctggcagccggtgtggtcgacggccgaaacatttggaaaatcgatgttgaagaacgccttgatgcagctctggatatcctcagccacgctgatgttgaggagttatggattcagccttcaagcagccttctgcacgtgccggtggcgaaacaccctgacgagcatcttgaaaaggatttgctgaacggcctgtcatacgctaaagaaaaactggcggaactcggcgtcttaaaagaagggcttctgtccggcaaagcggccgtcagtgagcagatcgaagaatcaaaaacggcacttaaggctttaaaagcattcgcaacaggagcgaactcagctcaaaaagaagagctgaatcagctgacggaaaaagatttctcccggccggcaagctttgaagaacgattggcgctgcagaatgaatcactcggtcttccccttctgccgacgacgacaatcggaagcttccctcaatctgccgaggtgcggagcgcacggcaaaaatggcggaaaaaagattggacggatgaacagtaccaagcctttattaatgcggaaacgaagcgctgggttgacattcaggaagaaatcggcttagacgtgctcgttcacggagaattcgagcggacggacatggtcgaatacttcggtgaaaaactggccggattcgcctttacgaaatatgcatgggtgcagtcttacggttcacgctgcgtacgtccgcctgtcattttcggagatgtcgaatttatcgaaccgatgacggtaaaagatacggtctacgcccaatcgctgacggaaaaacacatgaaaggcatgctgacgggacctgtcaccatcttaaactggtcattcccgcgtgtggatatttcaagaaaagaaatcgccttccagatcgggcttgccctcagaaaagaagtaaaagcgcttgaagatgccggtattcagattatccaagtagatgaacccgcgctccgcgaaggactgccgttaaaaacgcaggattgggatgaatatttaacttgggccgcagaagcattccggttaacgacgtcttctgtgcaaaatgagacgcagattcatacgcatatgtgttacagcaactttgaagatatcgtagatacgatcaatgatcttgacgcggatgtcattacaatcgaacacagcagaagccacggaggatttttagaatacttgaaagaacatccttacgtgaaaggcctcggactcggtgtatacgacattcacagcccgcgtgtgccggcaactgaagaaatctatcaaattattgatgacgcgcttgaagtgtgtccgactgaccgcttctgggtaaacccggactgcggactgaaaacaagacagcaggaagaaaccgttgcggcattaaaaaatatggtcgacgccgcgaaacaggcacgaaaaaaacaagctcagcttgtataaaaaaacagccatccgcaaatcgcgggtggctgttttttctgggcgtgctatttattcttcagcgccttcgcaagttcacttagtgaatcatgctgcttaatttgatagccccgcccttctttttgcaaataccctttttggcagaattgcgtcagcacatgcaagagatgacggtaagatacacccaaataatcacagaccgttacgtgcttctctttataaacccctttataagccgtctgcaaaataaaatcagcaagccggttttcaagcgggaacgccagactttgtgaatatttcgaagccataagcgttgccttagcacttaaaaacttagccagctcacgcaggaatttcgcatcctgcagcaattgcgcgcggcagcggtaaataggcagagcaaaacaaacagtcttcgctgaggcttgaattccttttgtgtaatacacttcatgtaatagttccatctctccgatgtaatcatttttgttgataaaattaattaaagaaactttcccgttttggtgggttacatatattttcgcttttccttcaatcacgtaaaacaggaagtcaggcctcctgccctcttgaataatccattcgtcccgctcatattcgcgcacttccataaactcttcagcggggaaagagaataaatgcgcgattgagtgtttttctaactgatgccgctttttctcgcctttataaacttccatcgtccaccccaaaaatatgagatatctcatattgtctttatgtctttacatgataacatgccaattaaaggaggaacgggaatgaaagcatatcgctggatgagtctgcatttttttagtttttttatgacatggggtgtttttctgccctattggacgggatggatggtgcatataaaaggggtttccgtatccgaagccagtttcattatgagcctgggcttggcggcaagagggatttccacattatttttcttcccttatttatcaggaaaattcagcagcaaagccttattaaacggcgccagaaccgggacgcttctcgcacttttatgttatattcccgctgattcttttcaaagcctgcttcttgtcacattagtgctgcatgtgttttaccctgctttaatgcctgctttagacagcgcttgcggcgtccttgtacagcataacgaattaaaggcctatgggacaagccgacagtgggggtccgcgggttttgtttcagccggcgtcatcctgtccgtctttacaggtatattcggagatcaagcgattttatgggcactgcttttgggcaccctgatattcgcatgcctcagctttatgcatgcgccagctgttctttcaaaacggccggaaacagaccgcgcaagaaaagagggcatgtttgctttattccgcatcaaatatttcggtctggtgctcgcaatcgttatcttactgcaggcggcacacgcgtcttattacaattacggttatctctttttgcaggaaatcgatgcccccgcatatgccatcggaatcattatcaacatcgccgttatcgcggagattatcttctttgcaatcgctgaccgatactttcatcaatttacggcaggctctttgctcgccttggcggcgcttggtgctaccgtacgctggatactcgtatttgcatttccgcatgtcatcattttctgtattgcgcagacgctgcatgcctgttcattcgcgatgggacactatgcatttatgaaatacttaattaaaaatatttcacccgcgcaaatcccgaaagtccaaggcatatattcagcgcttgctctcagctggagcactgcggtatttactattttcggaggttttttatatgaaattgaaccccggtatgcctttatcggaatgattgtttgtacgatcccatccatgcttctcgcccttttatacagaaaacttgaaatgaaaaagagagtttttgcaggaaacgcacaagatatatagccatcgctttatagacgatcacatgtcccgctgtcattttgaccgatttgcgaatgctgtgcgatgtattttctctatatttaaagtatttccttcatatatgatgaaatcaaaaacagcggtataacccgctcaattggttaatgaagggaatccattcagaaacttggacagaatcagtgaatatactgatacagtactgcttacgctcatttcggggaactttgttcgtaataaaatgattttcagccaactcataaggagggacattgtgtcacagcctaatttgcccaatatcacccctgtcgttacactttccagagacgataccattaaccttcttctttcgtcaattgctatggaagagctgggaatggcacatattctgaatgcggaaggggaaaaaatccaatacgcgctcggaacgattcccggattaacagggcccccgtcaagtcttgcggatattcttaacctgaatgagagcgtccgggatacgcttgacagcttaatgaaacaggagcttcttctcggttcaaaattggacagtatctcaaatatccctacactggcgggaccgactggtgctacggggccgacgggaccgacgggagcagtcggaccggccggagcgacggggccaaccggatcgatcggacctacgggggtcaccggtgcgggccttcaagggattgttgcttttaatccgctgattgcccccacttacacaaccggacaggttgtcttgtataacggaagctcttacgtcgcaaacgtaaacagcccggcgggaacccctggagcctcagctgactatacacttttagctgcggcgggaagcaccggtgctactggcggtaccgggccgaccggaagcaccggcgttactggcgacaccggaccgactggaagcactggcgctactggcggcaccggaccgaccggaatcaccggaacaagtctgacagcaacttccggctatgcgagcaatacgggcggcggtgttgtcgcagttattgtcggcggcacgaccatttccttaccgaatgaacaaaacctttcggcagatattacggctaatgccgcaaataccatatttaccgttgctccggcaggacggtactatatttcctaccatattaatttaacggccggcttgcttgtaagttcgcgtattttaatcaacggcactcctcctgcaagttcgattatcgccccggtcgcgtctttggcaaactttaataactcctttattgtgactttgccagcaggcagcaccatccagcttcagctgttcggattattgggtgcggccacattgcttggaggaagcgtcggtgcagctttaaacattattcgattatcttaatggaacatgcaaaaaaaggatcaggcgtttgtccgctgatccttttttaattgagacagaagttctttcgcgggtttaaattgaggattgaacttcacggattttttggcgtaagcgatggccgtcatatcatggtttaatgcagcatggcatttcgccatataataaaaggctctgaaatcggcggcaccttttaaaatgaagtgatcagcattttctccttcaacctgcgttccgttttcaaatgctttgattgccgctctgtacttttccaaatgatataatacaaggcctttataataatgaagattgctgtaatcaggatatagcttgagcactttttcaatcccttgttcggcttcttcataccgtttgagctcaagcaatattgtatatttcaaataatacaggagagacggaggcattcgtttttcgcttaaaaattgaaaaattgagccgttgacaagatgtaatgctttttcatagtctttgattctgtagcattcacttgccaaatgatagacaagccacggatcaggattttcctctgaaagctcttcatttaaaatgctgatattccgtttatgtttttgcttgatcttttcttcctgctccaagtagccgtagtgatgaatcacacatgggagcgtgaaaaaagcattgttttcttcctcattggaagccgagatattctcgtgaattctgccttgatacagaaggcctttatgattgcggaacagtctcggctgcatgctttcaaacgcttcgttttcatcgagctgcttccccgtataattgatgattttcaaaaggccccggctcggtaatccgtcatgaagcagcgaagttaaaaaacggcccgtctcctgatcgagctcttcatccgcgtcaagcactaaaatccaatctccttcggcatgctgcagggcgtaatttctggcctttgcgaaatcattctcccattcgaaatcaaacactcttgcctgaaagcttttgcatatatcttttgtattatcttgtgatccggtgtctgcgatgacgatctcatcagcgatgtcttgtacacttgataaacaacgggagatgtatctctcctcgtttttcacaatcatgcaaagagtcagtttacattcagcatttccgctcattttctcacctttcccgattttggagttgttgattgaaccaaggccgttcaggagtgccgttcatcgtgatgatgacaggccgcacccatctgacggcaggttcggcagtttccgtattccattcctgaagctgcctgacagcccgcttcgtaatcggatgcgcccggaattcgcgcgggctttcagaaatgaattttttcgttcgttccgtaactgtcttcatttcaagaaagtgccgctcatacatctgcttctgctcttcttccaagctgatcattaaaaacagacggccgcctgtttccatctgccagcggcacaatgcggagaacagcctgatttcttctttgtaatttgaaccccttcttttatccacggtcacagataatatatgtaacagcgccatcgtgagacaatgcatggcttcaaaagatgcgtgtttcgcttttgagatgcttggatacggcatatgcttcacccgtctctttttttatgaacgctccccgccttttttcttccaaccgcagtcctcacaatccccacactcacagcagccaatgcggccgtaaaacaggccgtcacacggatcttccggatcactgggatcgtctggattccacgggtcatcaggatcgcccggatcactcggattgctcgggtcgtccggattccacgggtcatcaggatcgcccggatcactcggattgctcgggtcgtccggattccacgggtcatcaggatcgcccggatcactcggattgcttgggtcgtccgggtccatacagacttcagaatcctgtaagaagataatgtcctcaagcttcgtctgcaaaaggagttgtgatttcatgacggtgcgcaggagccgttcagtgcttctattaattgatgacaattcctccaaggagggatcgccggaagcgccgagaaacatttgaatcctttccgcttccgcctgcagaatatgggatagtccgatttcttccatagccacggatgaaagaaggaggttcagggtctcacatctggagagtgtaatgtcgggggtgatgttcggtatgtttggaagagacatcgatttctccctcttttctcttggtgtcattatgcaaaagtgctatatcgtattcttattccgggagagaagagatcattactgatgttttcgttaataaaatatcccggatataaaatccgggatattcgttcgttgatttattttaattcaagtttgacgtctacatttcctcttgttgcttttgaatacggacagaactcgtgagcggcgtgcactagcttctccgccgtttctttgtcaagatcttttgtatcaatgacgagcgttacgccgattttgtaacctccgtcactctcatcttttaaaaggctgacctgtccttcaatttcagaggtcatgtcgattttttgtttttgggcggcgagctcaagcgctcccccgaagcaggcagcatatcctgccgcaaagagctgttcagggtttgtgccggtttctccgtctttttttgcattcggcatgatgatgtcaaaatccagcaccccgtcttcggatttaatatgtcctgctcgtccgccgactgcggtcgcttttgaagtaaataatgccattattatcagcctcctcattgtacttactgtatatattgcccctgctcatatttttaaacatgattggaataggaaatgggccgtttttcggctacaataggggtaacgttaacaaacaaagagttggtgaaagaagtaatggcagaaaaagattttgaacatatgaaactggagaatcagctttgttttttgctgtacgcaagctcaagggaaatgacgaaacggtacaaaccgctgcttgataagctcaacgtaacttatccccaatatttggcgctgcttttattatgggagcacgaagaactgaatgtgaaacggatgggtgagcttttgtacctggattccggaacgctgacaccgatgctgaaacggatggagcagcacggaatcatcatgagaaagcggtcggctgaagacgagcgatccgtgacgatcagactcacagatgaaggacgggccttgcagaaaacagcggcggatattcccattgccatgctggaacagacgggacggtcaaaagaggaattaaagcagttaaagcagtcgctttatgaggttttgaatacgctgcacggcaaaaaataaggatgccccgaatgggcatccttatttttattctgctgccagaagcttcacttcaatatttcccgctgtcgcttttgaatacggacagacaccgtgcgctttttggataagggcttcaagctcctgtttatcaatgccggatgctttgacctcaagcgtaacgcctagtttatatccttggtctgcttcatctttcagcagactgacatgcgcagtgacctctgtttcaatactcagacgctcttttctcgctacgagctgaagagcgctgtcaaagcaggctgaatatcctgcggcaaacagctgttcagggtttgtagcatgttcgagcttttttgctcttggcgttcccggcatggcaacatcaagattcagcactccgtcagaagacgtgactttcccttcacgtccgccggcggctgatacggttgcagtaaataatggttttgtcatgtgaattcacctctgttatattgtgtacaatttaattttacacaatataatagagaccgtcaatctttccgcataaaaaaagcctaccctttttgaaggataagcttaaaagattatacgcggatttgtccgtttcctttgatgatgatttttgtagatgttaacgccggaagccccatcggccctctcgcgtgaagcttttgcgtgctgatgccgatttcggctccgtatccgaattcaaaaccgtccgtaaaccgggttgaagcattatgatacacggcggcggcgtcaacggcggtctggaagtaagccgcatgctcggcgttctccgtcagaatggcttctgaatggtttgtgccgtactgctgaatgtggcggaccgcctcctgtacgtcctgcaccgttttcacactgagaatcggcgccagatactccgctccccaatcggcttcttctgcttgtttcgcttgaggctccagtctgcaaatcacctggtctcctcggagctccacccctttttctgtcagctgattcagcagctttcgtccgtgttcttcggcccatttttcatgaatcaaaagagattcaatcgcgttgcagaccgaaggacgctgtgttttggcattgatgacgacctcgcttgccatttgaggatctgctgactcatctatgtacacgtggcaattgcccgctccggtttctaaaacgggtacggttgattccctgaccacaagatcaattaaatttttaccgccgcgcgggatcaatacatccagcccgtcatttaatgtaaagagctgtttggcggtttctttgcttgtatcttctatgagctgaacggcatcaatcggaagctttgacagccccagtgcgcgtttcatcacactgacaagcgctatgttgctgtggatggcggaagaacttcctctgagcacaaccgcgtttccggttttcaggcagagtgtggccgcgtctacggtaacgttcggtctggcctcatagatcatgcccactactccaaggggcacgcggattttttcaatggataatccattctctttttgaatggtctccagcgattcaccgacgggatcttcaagaccgatcagcagttccacggcgtccgcgatatcgagcaggcgtttttcatcaagagtcagcctgtcaataatgtcaggtgtcagtcctctgttccgtcccgcttcaatatctttctgattctctgttaaaatcagccggcgttcatttctgagtccgtctgcaatacattggagcgcttcgtttttttcagccgtcgttttcatgaccatttcggcagccgcttcttttgccaaggctgctttttgcaatacttcactcatttgtgttccccctcgtcaaataaattcacccaatcatctctgtgaatcacttccacctgcttcgttcctgaaagctggtcgctccgcttccctttggcttctaaaatttcatcggatgagtactgcgtctgccctttgccgataatgccgccgggccctttgacttccactacggcccctttcggaaaactgccgcagacatcggcgacgccggccgggaggagacttgacccgttatgaatcatcgcctgctccgctcccccatcaatgatgatttcccctgatatcggagaatgaaacatgatccattgccgtgtattatttactgaggacaggtctttatcgccgatataagtgccgtcgccttttccgtctaaaattcccatcagtttttcccgtccggagccggttccgataaataccttcaccccgagcgacaatgcggtctgggcggcgagaagttttgacttcatgcctccggtgccgacctttgagcctgctgatccggcatatccgagcaattctggtgtgatgtcattcagatagtcgaaccgctttgcgtccgggttttcattcggattggcatcgtacagcccgttaatgtctgtgagaatcattaattggtctgcatgaatcaaaccgcttacaagcgccgacagcatgtcgttatcaccgaacgtcagctcttcgactgatgtggaatcattttcattaataatcggcacgactccccgctccaacagttccattacagtggcataggcatttctgtaccgctctctttttgagaaatcatttcttgttaataaaatttgtgccggcgtcagaccgtatctttttaaatggtccatatattgctgcattaaaagtgtctggccgactgcggcagctgcctgctttccttttatcgtaacgggtcgcgacggatagccgagagcggaaaaacccgctgccaccgcgcctgaggtaatgaggatcacttcatgcccgttttcttttaataaagaaatggcttccgtatgttccttgatttttgcttcatcaatacttccgttactgttggtgagcgagctgctcccgattttcacaacaattctttgttttttcatcgtttctcctccgtggcaatcaatccaaaccggctctcgtcaataaaaaaagcccattccgtcctgaaaaataaggacgaaatgggctttccgtggtaccaccttgtttgaacgcgtttttcacgcgtcccgctttcctgtaacgccaggttatcgcgcctgagttttcccctcaggactccaaggcaggttcggcaggtttcatgcggcaaaatgtttcagcgggccattttgctctctgtcacagaaagttctgcgtactgatcctcttcaacgctcaatgatttttttatattatgcaaagaaaacaggttcttgtcaagacattttcatccataaaaaacagtccgcctccccggcggaccgccattaattaaatacgatcgttttgtttccgtgaacgatgacgcggtcttccagatgccattttacggctcttgccaacacgctccgctcaatcgttctgccgatattcttcagatcctctgcgtgatctctgtgatcgacgcgttcaatatcctgttcaataatcggcccttcatcaagatcgtccgtcacatagtgagaggtcgcgccgattaatttcactccgcgctcataagcccgtttatacggattagcgccgataaaggccggcagaaatgaatggtggatgttaataatccgattcggatgggcagatacaaaatcagacgtcaaaatctgcatgtagcgggcaagaacgatcacatcaatcttataccgctccagcagctcaagctggcgccgctccacttcggcgcggatgtctttgttagctttcatgtaatggaacggaatattcagcggttcgaccacttctttggcctcttcgtggttgctgatgacgaccgcaatttcggccatcatattgccgctttgccattcccaaatcagttcatgaaggcagtgcagctccttcgatacaaagatcgccacccgcttcagctcacttgccagagacaggctccatgtcatgccgaatgtctgggcgattgaggcgaacgcctgctgtaagtcttcttttttctcacgaatgcccttgcagtcgaattcgatcctaagaaaaaaccgtccgccttcagggtcagtcgtgtattgatttgattcaataatgtttgcgccatgttcaaacaaaaacgccgacacggccgatacaattcccggctggtcggggcagctgacaagcaggcgccctttttcctcattcccgcggcggtattctttcagccgctgtgtcatatatgaattcatctgttttaatccctcgtatcttcataattcgtaacttactaatagattatactgaagatttgataaaaatcaatttacgaaagaattttcagccctacggcagcgcataaaataagcgcaatgaaaaagatgcgcttcgcatccttctgctcgccgtagaaaagaatgccggctaatgcgccgcccgccgtgccgataccggtccagatcgcataggccgtgcccatcgcgatcgtctccatcgcataagaaagcagggaaaaagaagccgcaaatccggcgataatgaaaagaatccatttgactttcttttctttttgaaattgattcattaaaatgaccccgagcatttcacaaagacccgcggctatcaggctgatccaatgcattacgccttctcctccttcgtctcaggcttatcctgtgtgaccagctttaatccgatgacaccgatcagcaaaacgccgatcagcacgattttcaccggatcggcctgctctttgaaaagcaggatttcactgagcacggtgcccgctgtcccgagtccggtaaagaccgcatataccgttcctacgggcaggctgtctgtcgccttgattaatagataaaaactgatgatgattcccgtaatcgtgccgctccacgccagtgccgaatcagcatgtttcaggccggtgacccataccacttcaaatacggccgctatgaccactaaaccccatttcatgttcttcaccctttctgtatccggacaatacaaaaaagcccggatagtcgtctcacatgagattgactctcccgggcttttttccctccgtgtgcatatgcgggatatgtccgcatatgtgttttctctcggaccaggccatgtataaacatgcggaaccctagaaaacatgtctgttcgtatcatactacatttcgccgaaacgttcaacgtcagatgtgatgtcaaaaaccgtcagctgtctctcccatttggtaacggtctcaccgggcaccatgccgattttttccgcgacacggacggaggcagcgttttccggatcaatcagcgccgctatgcgtccgtattgctgcgtatgaaaaccatagtccagacaggcgttcgccgcctctgtcgcatagccgcagccccagcggcggcggacaaacatatagccgatttccatcaaagtgtttccgtttaccgtctgcggaacgattccgcattgaccgagaaatgcgcccgtctctttatcctctgcgatccaaagactgacgccgtatcctttggccaatcgtttgttccaggcaatccattccttcgtttcccgtctgcttttaagagaaggataatatttcatgacctctctgtcggtaaacagcccgtacaaattttcttcatcgtcatcccgcatagtccgcagacggatacgcccggttgtcaggatggtgccggaagacttatgtttcatcatgcacgccacgtctcctttccctgtaatagattatggatccggcaggaaaagtcctttctcagcataaaaaaaccgcttttaaaaaaagcggtttgatgattaccaaggtttatctgttccgagcgcctcggccagggccttgctgtgttttaagcggttttttcgttctccggcgcgctgaacggccgtattgtgaagcatgatttcttcctcggtttccggcacgatccgcggaacgggtaccgatttcccgtttgaatcaagcgcgacaaaggtcagaaacgacgttgccgcaagctcgcgttcgcccgtcatcagatgttctttaatgactttgacaaacacctccatagacgatgtgccgacccatgtgacgtaagattcaaggcatacggaatcctgttggccgatggggcgcaaaaaatctacagaatccattgaggccgtgactgtttcacaccggcagtggcgggccgcggaaattgaagcgatatcatcaatgtagctcatcagctttccgccaaacagcgtattgtgattattcgtatcaagcggaaaaaccctgcttgttttaacaacccttgtttctttgcaaaatcttgattctggcaacttcatattatttaaactcccctttggtgtctggtcgttttgactcattcatctgtaccctattaaacaatactttgaccgttttgtctaaaattttaaatattaagttggttagatattctctcataaatgtttcattattcatcacatccgggaataataaacgcacattgaataccgataggaggatatcacatggacgtatccattcccaaatccacgcggaaaccggcttgccgcagtgagtttgatgctttgcagacagtcatcttatgccggccggaacacatggccatcaaggatattattaacggaacgcagaaacatttcaaacaagaaaatattaacatacccgttgccctcaaacagcatagcgagtttattgacattttaagatctcatcagattgaagtcgtcctgctgcctgccgatcccgcattgcctgagcaggtattcacccgggatatcggatttgtcttaggcgagacggcgtttatttcaaacatggcggcttcagtccggcagggagaagaaaaagtgtttcaaaacctgcttgacaataagaaaatcccctatacgcgactgaaaaaagcgaacattgaaggcggcgacatcttgatcgcagacggcaccgtttacgccgggctgagcaagcgcacggataaagcggctgtccgggagctgcgggaggcgctgccggagatgacggttgtgccgatccctctcaaggaggatttcttacatttggactgtgtatttaatatgatctcggaaacggaggcgctatactgcaaaaatggcttgcggcagaaagaaattgatcttctcgccgaacgttttgagatgatagaagtgcctgaagaagagcaattcacgctcggtcctaatatcttgtcaatcggcaatcagacacttatcagcctgccgcagcaccgtcatacgaaccgcgagctcagaaaaagaggttatacagtcattgaaaccgagttttccgaaattattaaatcaggcggttccttccgctgctgcaccttgccgcttgtcagaacatcttaaacatttacaaggcagtttccttcaagatacgttaatatagagaagacaagactctaaagggggaaaccgaatggctaagtacataggatacgcgggaacatatacaaaaggcggaagcgaaggcatttattgttttgaacttgatacagaagcgaaacggctcagccgtccgaagctggcagcaaagctcggcaacccgacatacgtcactccgaattctgataacagcatgctgtattccattgaaaaggcagacggaaaaggcggcgtcgcagcctatcagattcatcagaacagcggggaattaacttttgtgaaccaccagctgattgaaggcccgtctccatgccacgtcagcattgatgataaacatgaatatgtgttaaccgctaattaccacagcggaaaagtgcacgcctttcccgtcaatgaagacggaagtctgcgggagccggctgccgaagccgctcatacgggaacaggtcctcatgaaagacaagagaaaccgcatacccatttcgcaggctatacacctgagcataactacattgcagccgtcgatttagggacggatacgctttatacttaccaaatgaaaaacggttcgctcacagaggtgaaaactcactctttcgcaccgggttcagggccgcgccacatcgttttccatccggcggaaaaatacgcctatgtcatgacggaaatcagtaatgaagtcatcgcgcttgaatacaacccgaccttaggtgaattcagagagttgcaggtcatttccgctttgcctgaaggctttacggacaaatcgcaaggcagcgcgatccgcatatctaaagacggcagatttctttatgccgccaaccgcggacatgacagcatcgccatctttaagatcaaccaatattccggtgaattgtctcttattgaatgggtgccgacagaaggcaactggccgcgtgatttcgcgtttgacccttccgagacattccttgtcgcgtcaaacgaagaaacgggaaatctggttttgtttgaacgcgacccggaaacaggcaaattgactctgcttcaatctgacattccggttccgtatccggtctgcgtgtcatttctgcatcaggtttaatcaaaaaagaaagctgactttatattgtcagctttcttttttgtataaatggcaggcgacaaaacgccccgccttcacttcttcaagctcaggcgttatcttactgcatagctccatcgcttcaggacaccgcgtcctgaatacacagccgctcggcgggttaagggggctcggcagctcccctttcagaataatccgttcacgcttgtcctcaagaagcggatcaggaatcgggattgaggataaaagcgccttcgtataagggtgaagcggttcccggtaaagcgcagcgctttctgtaatttccatcatgcggcccaaatacatcacgccgatccggtcgctgatatgcttgaccattgataaatcgtgggcgataaataaaaatgtcagccctttctctttctgaagcctttttaaaaggttgacgacctgagcctgtaccgacacatccagcgcggaaattggctcatccgccacgataaattcgggatgcagagagagcgctctggcaatcccgattctctgcctctgtccgccgctgaattcgtggggataccggctgccgaaatccggatggagcccgacagcttcaagcagttcatccgctatcatcagacgggcttttcttgtattgtaaagattgtggatttccatcggctccataataatttcccttacggtcaggcgcggatttaacgaggcgtaagggtcctggaaaatcatctgcagcttgcggaagaagaccgaccgctgttctgccgcggcacggtgtatatccgtcccttcatatgataccgaaccggccgtcgggtcatacagacggagaataacccttccgagcgtcgatttaccgcatcccgattctccgacaagtccgaatgtttcccctcttttaatgtgaaaactgacaccgtcgactgcttttacggctttctttcttcctgcgtcaaaatgcattttcagcccgctgacttcaaggagcggagatgccgtcattttctattcccccttttcgcttatacagcggcgtacggtgcataattctttttcatagacggttccttccaaagacagcacttcgattgtttttcccgttttcggggagtgcagcattcggccgtctcccagcgccaaaccgacatggtggatcgcgccttttccttcttcataggcgaaaaacaaaaggtcagccggcaggatatcgtttaccgccgcgccgcatccggcttttgcttggtccgttgcatcacggggaagggtatagccgtttgctttaaatatcgaatacataaacccggaacagtcaaacccgaaaccgctcagtcctccccataaatacggaagcccgagaaacatcatgcccgtttcgatgacatcggccgcccgtccttccgtatgccggcactcgtctgcgtcagcttcatttacgaacctttctccgagcggcgtcaccacccggaaaaagcctttctcacgtcctgatgccggaagacgcgttaagaaacttacttccaagtctggttcgccgtttgtgtgatataaaaaagctgtcggtttggtaatccatacggcgggggaagatgcatgaaagccgtcttttgaaagctggctttttttcatccaccccggatatccgcgcacatccttgtttgaaggctggccgggaacggcgacaaaagcccattccccttcctctttgagaatgatcacttcttccccgaaaagcgcttgcgtttggacaaggttgtctgtgcataattgcagccgctcttcatatcccatagacgctaaccattttctgatctgcggcgggttttcgagcatcggcgcatcatacgaacggggagatgacggcagcgtccatacgttggctgctgccgctgtaacggctgctctcatcttttcgccccctcttgtatcgacacaccggtaatgccgagacccggttcgtcgggaatcgcaatctgactgccgctgtatgtgatgccgccttgaatcaaatcatctttcagcataagcggcgcatcaaaatcaaaccttgtcacattccgtttgcccgcggcaaaatgggccgcggcggtgatgccgagtttggtctcaatcatgctgccgaccatgcattccacgccgcacgtttccgccatcgcattgattgtttccgcctgctttatgccgcccgctttcatcagcttaatattaattaaatcggcgcttctcgtctgcagcacgtgaaaggcctgacggggggtaaagacgctctcatccgccataatcggcgtgtctacggcatcggtaacctgcttcagcccggcgatatcgtctttgtgaacaggctgctcgaccagctcaatgccgaggccggcgtcttccatctttcggatcgcggtcacggcttctttcggcgtccagccttgattcgcgtccagtctcagtttgacgtttccgccgacacgtgatctgatcgcccgaatccgcgcaacatcgtctgatatgtcacctatgccgacttttatttttaaaatatgaaatcctttgttcacataacggtctgcatcccccgccatctcctcaggagaattgacgctgacggtaaaatctgtttccagtgtattccgatagccgccgagaagccggtaaagcggctgtccatgcatttgcgcccatccgtcatatacagccatatccaccgcggcttttgcgctttgatttctttccaacagccggctgatatcaaacaaaacggcttccatgccggaaaggctccgccccaagagagcgggcttcagcacatcgtggacggcgctttcaataccggccgcgctgtcacctgtaatgacaaccgtcggcggcgcctccccccagccggtcagaccgttgtcaaaagtgagcttcacaatgaccgattgagcattgtaaaccgtgcgtaaagcggtcttaaacggctttttcagcggcacggacatccgtcccgtttgaatatctgtaatcctcacgcctgatcactcccttccggaaacccccgattcaatcgttaccgctttggccgccgtatccataaccgcgcgggctccgatcggaacagcgaagctcggtgtacaatggccgattttaaagcctttgagcgcgggcttccctgatttaacaatgtaatcgttcagcacttgctctaaagtaagcgacttttctttatgtttcggttcgcattggtgaaaatcacagaccaggattccggctgcgtctgacagttttccggccatctttaattgattcagcattctgtcgatttgatacggctcctcatcaatatcctcgataaacagcaatttgtcttttgtatcaatttcaaacggcgtgccgagtgtggacgtaatgagcgacagattgccgcccgcaagctctccctcggcccttccgcctgtcagcacctctaagggagaaatgtcctccgtataggtaaattccgtttctgtaaaaagctgacgatacgacgcttttgtcaggggatcagcatcttcaagcccgacatcggtgctcagcatcgggccgtgaaatgtgacgagccccgtattttgatgaatggcggtatgtaaaaacgtgatatcactgtatccccagaaaattttcggattgcggcggattaagccgaaatcgatgtcggcggcaatgcggcccgtgccgaatcctccgcacgcgcatatcaccgctttgacattctgatcactaaacatgtcatggagatcatcgagacgcgcccggtcctctcccgccaaatagccgtgacgggtcttcagcgcccggccgagtttcacttgaaggccaagctcattctctaaaaacagcagcgcggtttgcagtgtcccgctctcaggcgggcttgcgggcgcaatcacaccgaccgtgtcgcctttttgcagtgctttcggtttatggttcatgactttttcaatctcctttccggattgaaaagtgaaacacgccgctcctttaacggcaaaagagcggcgtatgtttccgctgtaagatcaggacttttccgcccacttcagatcaatgtaaccgacggggtgccggacaatgcccttcacgccgctgttctgcagatgcacctgattgtaaaagtaaatcggaatgatcggagcctcgttcatgagcagtttttccgctttatgcatgagcgcaaaacgttttttggcatcggcttcctgttttgcctgcttgatgtagccgtcgtatgccgcgctgccccagccggtgcggttcatggaattatccgtctggaaagcctctagaaaactgatcggatctgcgtaatccggtaaaaatgagctttgagagaactggaacttcagtcctttctgctcttctaaaaagacgttccattccatattggcgagcttaacgtctataccgagtacacttttgagcttctgctgaatcgcttccgctattttcttatgctccggttttgtgctgtatgtcaatgtaacggcgggcagcttgtcataatgctcttctgccatgcctttttccagcagttttttggcttctgattcatccggatttaataaactgccgcccgcttcgcggaaatctttcccgtcaggctgagtaaatcccggggatacaaaggcatgtgccggcttttcactgtttttggtcacataatccgtgatttctttctgatcaatcgctgccgcgaacgcttttctgatcttttcattttgaaacggctccatttttacgttaaaacgatagaaatagagtccggcctgatcccacgtgcggacattttttcctcccatcagctgctcgctcagctctgccggcacaaaggcggtatccaaatcccccgactggaacatctgatagtcggtattccggtcactgaccatcgcccatgtgactttatccagtttcactgtctttttatcccaatacgtctcgtttttgaccatcgtcatgctgtcgtcatgcttccattccgtcagtttgaacggcccgttgccgacaaaggtttttgcttcagtgaaccatttcggatcagccttggcgaccttctcattaatcgggaaatacgccggattggacacgacgctcagaaaataatcctgcggtgccgccaatgtgacgacaagcgtttttttatcttttgccgtgactttcacgtcttcttgtttgccttttccgctgttaaattcttccccgcctttgatcatgtagccgagaaaagcggaagatgcgcccgttttcggatcgagcatccgtttccaggcgtacacgaagtcttccgccgtaacgggatcgccatttgtccattcggcgttatcccggatattgaaggtatatgtcagcttatcagcggacaccttccagctttccgccatggccggttcgggcttattatcttttccgagcctcgtcaatccttccatgatgttattcagcggctgccaggaaacattattaaatccgatcggcggatcaagtgaggtcggctcattttcgttattgagccgcagcaccgtttcacccccctgttcttttgctttgccgggttctgtccccgcctgttcattggctgtacagcccatcagagcaaacgaaacaacagcaatcacaccgatcgcccatctctttttcatttcaatccccctttttcctctgctgccgtcagctgctgcttcagccgctctgcacggtgatcctgaagccagcagttgacgatatggcttttggatttcacggttgttgccgggtataccttttcacagacgatcatcctgtccgggcagcgggcggcaaacgggcagcccggcggcggatcgaataaatcaggcggcgtcccgtcaatcggcgacagctcactatcctccatatccagccgcggcactgaacgaagcagcccctttgtgtatggatgagccggacggtaaaaaatatcatgcctcgtgccgatttcggcgattttccccgcatacatgacggcgactctgtcggcggtctgagcgacgacgccgagatcgtgtgtgatcagaataatagacacgcctgtttttctttgaatcttcttaaataattcaaggatttgtgcttgaatcgttacatcaagagccgttgtcggttcatcggcgatcataatttccggctcgcagatcagagccatcgcaatcacgatccgctgccgcatgcccccgcttaattggtgggggtactgcttcaggcgggatttcgagtccgggataccgaccagatccagcatggcgagaacttcggattcagcttgttttcttgccatggcgcggtgttccaacagcgcttctgagagctgattccctatggtcaaagtcggattgagcgccgtcatcgggtcctgaaagatcatagaaatatcgcgccctcggattgcccgcatttcccgatccgacattcggcaaaggtctttctgtttaaattgtatgcttccggattcaatctttgccgaatgtttcggaagaagacccatcacggcttgtgacgtcacgctttttccgcagcccgattcaccgacgatcgcaaacgtttcacctttatataaatcgaagctgacgcctcggacggcttttacagtgcctccgtatgttgaaaaagtaacatgcagattttgaacggaaagaacttgctgcgccatttttcctacctcctcagtttcgggtctaacgcgtcctgcaagccgtctccaagtacgttaaacgcgtacatcgtcaaggaaatgaaaaaagcggggaaaaacagccgccaccaatggcctgataaaatcgccggcagcccgtcgtttgccatgactccccagcttgcaaacggcgcctgaatgccgagtccgagaaaacttaaaaatgattccgcaaaaatcgccgccggcaccgtaagcgtcatttggacaataatggctcccatcgtattcggcagcagatttttcttaatgatccgaaatgttttcgctccaaacgttttcgaagccaatacgtgttcatcatgcttcatcctcagcacctgccctctgacaatccgcgccatgccgacccatcccgtcacggtcagagcgacgataatggaactgagccccggccccatcagcaccattaacaaaatgacaacgagcagatacggcaatccgtagagaacctcgatgattctcatcatggcgctgtctgtccggccccctttgtagccggcgacgcctccgtagatgacgccgatcaaaaagtcgatcagcgccgccatcacaccgacaaataaagagatcctcgctccgtaccacgttcttgtaaacacgtcccggccaagttcatcggttccgaaccagtgtgaaaaagacggcggaagattctgctcggcgagcgtctgccttgtcacgctgtgcggtgatatcagcggaccgaacacagccgatagaaacaggcagcataatatcacaaggccggccatcgccaatttgttctttttaagccgccgccacgcatcctgactgtaagacaggctcggacgcttgaccgactcggtttcaccctttctttccgcgcccggctgaaaccagtcatcgggcacttctgtgtgttttaccgtttcttgcgggagattcatcaggatcaccctttcttatgaagttttatgcgcgggtctaacaggccgtatgccaaatcaaccagaaacagcaagacgatcagaatcacactgtaaaatacggtcgttcccatgatgaccgggtaatctcgctgattgatgctttctacgaaatatttgcccattcccggtatggcaaaaattttctcgatgacgaaactgcccgttaaaatacttgcggcaagcgtcccgagtactgtcacaacaggcataagagcatttttcaatgcgtgtttgatcacaattttgacgggagaaagcccctttgcttttgccgtgcggatgtaatcctgagtcagcacttcggccatgcttgatcttgtcagcctcgcgataatggccatgggaccgacggcaagcgcaacagtcggcaggaccatgtggacgggactcgtccaggtagctgccggaaaccatttcagatgaaccgcaaattgctgaatcagcagcgtagccataataaaattcggaatggaaatcccgagcaccgcaaggctcatggccgcatagtcgagaaagccgccgcgcctgagagcggccattatgccgagcgcgagtccggaaataacagcgatgatgatcgccgttatcccaagctcaaatgagaccggaaacccgcgttcaagcatagcgtttacactgtctgacggttttttaattgaaggaccgaaatcaaaggtaagaatggattttagatagatggcgtattgagtgataagaggttcgttcagatggtagtaggattcgagatttcgctggaccgcttcgtttgtgccccgctcttcgttaaaaggcgagccgggtatcactttcatcatgacaaatgtcagagtggtgatgacgaggacggtcataatcatggcgataaaacgtttgataaaataccgcagcaatgccgttcacccctttaacagaatgttgttctcatggcgagttctgtcatgacgagcatggcctgataggcttccggcatgtcttttgcctgaaattgaacgattgtcgttcccgggatgatttctgtgcccggcattaaatgggcccattcagcctgtccgtagttggcaaattcaatgcctaatacaggtctttcaggcggagtcagcggtttgaccttatctttatttttgagcgcataggctgttttttccgtcaggagccgtccggctttttgaggggacaggcatttgaccgcggttcttgaaatggtttgtttgacggcggcagtcgtcacattcgggatcagctcctccgcttcttttgcggcgcaatcatctccggcagccatgatgaccgggacatcgtaaaatccggcgagataggcatttaaccccagttcaccgaccggcttatcatttatgtaaaagtggcggacgccgaatatcatgctgtgcgacatgacgcccggcatcgacgctctcgcatgatagccgataaacatcacgcccgaatacgattcatcaaggccctgcatcatggaaaacggcttgacatcccccgtaatcagttctgcctcagggtgaagtttttccgcgagcagattattcatctttgagtggctgtcattcacggtcacttccgtgcatccgttattaaacgcttctgcgatgcaccagtttgcttcttcggtcatcagaaccctgccgcgctcataattgtgcatgcgggaattgacaaatgtttcatcaggcagtccggaaatcccttccatatccacagatagatacagtttcatgtaatgcctccttttttacttaaaatttcgatattaaattatgaatattctaacaaattatattaaaaaaggatgaaacatgcaatataccattctgccattatgggaaaaaacaaacccttttcaccgggaaaagggtttgctgatagaaaaagttacatactgtttttgcttatatgatgacgctgaaactgtctgaccgcacttctgtattcatgatcgggaatgacctgatgcctgatcggttcaggagcctgcggcgaagactgttcagccgcctgcttacggacggcatgcggtttatgcgccagcttatgtcccatgccggtcgcattcatgacaaatgataaacacactaaaagcaagcttaagatgaaagcaataagaaacaaatcgctgtatgtccccatcagcaggtcatgcggtgattgtgtgccgcgcgcgccccgaagcgtgccggaagcatctcttttcgtaaaataccctattaaaacaggtgcgcccatataaatgaaaagcctcaaaaactgaactgccgtcatgcgtttcaccagttccggaagcggtccgcccaacgcggctcccatcagtcctgctgccacaataagccctgtcccggccgccagcatcacgaaaagccccgcaaatagaataagcggtatatgatgatccgccgtcatccattggaaattcacgaacaccagtataacagagcctgttatgccgagcatgcccggaccgactttatcatatgctaatgcactgatgacagcggcgatggccacgcctcccaaaaggctcgcataaaggaatatcagttgagtttgtgacatatgatatgcggtctgaagctccccgtgaaatgcagaaagactgaccgctatggaaatactgcccgcagcgatcatgaaaacacccagaatcggctttggaatcagcataagtttaatcgaaatcagcgcatgttcgtttctgtactgcatgatcagcaagatcagaagaatgacgatgcttcctccaaatcccgccaatgtctgccatgatgaaaagccccatttcggcagatgaataaatgtataggcggtcagcacggctgatacacccgctaacagaaaaccgatgccgtcaaatggagatttttcagcatttttatgagcgtcatcccgcagccacatataactgaaaatgaggccgaaaaaagacagcaggccaaaaatgccgaacagccaatgccaatggccggcgcttgccgccgccgtgcctaaaacggttcccataatgacggacccgtaaaatccgccgatcaacacaaataatgcgtaattccggcgctcaatcggaaacgaaagcaccagcatcgggatcataatcatcagcatagtgcccgccgcagctccctgtaaaaaacggcccgcggcgagcggataaatatcatttgtcacagcagcaaggagcgctccgatgacacccgcggccatcgaaatcacatagacaggccgggagccgaatctttttcttaaatacggccccgccggcacgaataaggcaaatgccatattaccgataataatcggatgaaaagagtcaaagttttccccgccgaccgtctgccggacaaggctttggacagccgaaagagcggtattcgacatcagccccggcccgaccgccaatacagcgagcagagaaataatccagtgatgtttttctttcatgtgacagctcctttctgactatttgacaaagtgaaaaagctaacagatctcccccattagcttgacagaattttcatatcttttcatgtgaagaattgaacataatatctcatttattatttcaaatccgatggaaattgtcaatataaagcgccgccgtccgatttcgtctttttcacaatttcccacaatcttttcattattatcccacactttttgtttaagatggagtcagtaataataggcaaatcatgctatgatgaaatagagaaacggagtgaacatgatggataactatcgtgatgaaaatcggacagaccaaaaagaacaggaagtccttttagtaaaagaaaacccgcagacggccggatattccgcgccggacgaggacaagaaaaaacgaagcttcggctggttcagaccgcttctcggcggagtgatcggcggagggctcgccctcggcatctatacatttacgccgcttggagaccatcagactcaagatacttccaatccggctcccgctcaggaaacgtcatcggtaaccgccaagcagacatcttctgaatcagacagcggcaaatcggcaaacagctcatcggcaaattcaagcagcatttcgaatatggtggaagacatttcaccggcgatcgtcgggatcaccaatctgcagaagcagcaaagcagttccgatttattcggattcggatcaagctcagattcaaactcaaattcatcgggtgaagatgcggaaacgggatcgggttcaggcgttatttttaagaaagcaaacggcaaagcgtatatcattacgaataaccacgtggtcgaaggcgcctcttcccttaaagtgtcattatatgacggcaccgatgtaacagctaaactcgtcggcagcgactctctgacagacttggccgttttagaaatcagtgataaacacgtgacaaaaacggcaagtttcggcagctcatccgctctcagaacgggtgaatccgtcatcgccatcggtgatccgctcggaaaagacctttcccgcaccgtcacacaaggcatcgtgagcggcttaaacagaaccgtctcgatctctacgtcagccggtgagtcaagcatcaacgtcatccaaaccgatgccgccatcaatcccggaaacagcggcggaccgctcttgaatacagacggcaaaatcatcggcatcaacagcatgaaaataagcgaaagtgatgtagaaggcatcggctttgccatcccgagcaacgatgtaaaaccgatcgccgaagagcttctcacgaaaggacaggtggagcgcccttatatcggcgtgagcatgatcgacttggaacaagtgccgcaaaactatcaggaaggcacactcgggcttttcggcaaacagctgaataaaggcgtttatattcgcgaagtggcgcagggctcacctgcagccaaagccggattaaaagcagaagacatcattatcagcttaaaagggaaagaaaccggcacgggcagcgaactccgcaatattctctacaaaaatacgaaagtcggcagcaccgttgacgtgaagattatcagaaacggcaaggaaatgacgaaaaaaatgaaactgactcaaaaagaagaaacatcttcttaacaaaaatccaaggcagccgccttggattttttatgtacagcggaaactttaggcctggatcaaccgtatgacttagtgtacaaaggaggatacttacacatgaaacaaacaggacttttgctggtcgttacaggcctgatcttgctgcagctgagcattcagcttcctcagcaaaacgctgcttgaggtatgacgctgggtgcaagcattttactgaactttcgggaaccggactgatcatgcgctctctgcacacgcagaccggccgcagatgaatgaaaaaagccgcgggacattctgtcatcccgcggcttttatttcacataaaagcaccctgtccgctggccggacagggtgtttcggttaagacatatgctggtcccgataaatcttttcgtttttcatgccgtacgctttttgcacgatatagagcggacggtcttttgcttcgtcataaatccttccgatatattcgccgatcattccgagcattaatagaacgatgccgctgaataacagctgtatcacaatcagagaggaccagcccgtaatggtgctgttcgtaaacagcttcatgtataaaacgataaacatatagagaaaacccgctccggacatgatcattcccgcatagcttgccgccttgagcggtttatgagagaacgttgtgatcccgtccatggaaagcttcagcatttttttaagcgggtatttcgtttcccccgcaagccgctcatcacgttcatattctacagcagtctgcttaaagccgacccagctgacgagtcctctgacaaaaggatttttttcttttaatcttttcatctcatcacagacttttctgtccagcaggcggaaatctccggtgtcgagcggaatatcaatatcagtcacgctccgcagcagccggtaaaacatagaggccgtctgtttcttgaaaaaggtttctccctttcgtttcgttctgacggcgtacaccacatcgtagccttctttccactgctcaatcatatcaaggattaattcaggagggtcctgcaaatcggcgtcaatgacggcgattgcattcccctctgcataatccatacccgccgtgatcgcgatctgatgtccgaagtttctggaaaagtcaataattttcactctcggatcaatcagactttgctctcttaaaatctcaatactgcggtctttgcttccatcattgacaaagatcaattcataatgctcttttgtttgatccatgacttctttcaggcgctgataggttgtctgaatgacgggttcctcgttataaaccgggacgactattgaatattgaatatgtctgctcatgttttttcctcctattcatcagattgaagttcgtatagtgaagctgattgattcattccgcccggcccgccgctcattcggctgtttttacccgcggccttgctgctttttgtatcagccggatcactatttttcgttttctgatctgtgcttgattgccatttatctgaagatactttctttccgtttttctcaacccactgcacaatatcgttatttccgcctttgcccattccggatgttaagaagtattttactttcccttcttttacgagctttttaaattgagtcagcgtaatggccgggtcagacccgctgaatccgccgatcgccatgaccgcttttttcgttttaataatgtaaggcgccgccgtgttggaatcggttgcagcaaatagatagtccgctccggcgttgtgtttctctaaatagttgatcagttttgtattgacagatgcgttatccattcccatgccttttccgcttgttgaagcgagctgagggcctgtttcaggcaatgagctgttgcctccgtacagaagcggtgtgctcgcccaataaatcggcataaccatcaagacgagaagggctgcaagtgaaacataataacttagcggtttttggcgctgtttgaatacgaacagggcgattgctgccactgcgccgagaacgcctgctccgatgctccagcctgcgccgatttgatcattgtagtttctgaggataaacagctcaaatccggttgtcacaagaatagcggccggcaatagccaagttttccatcccgcctgcttgcggtacagatgaacgagggcgacccatcccgcaccgacaagtgccgcgatcggaggcgccagcataatgagataataatggtggaaaaattccgccacactgaagaatccggcaatcggcacaagccacgctgcccaaaagatcgtttccttctgttctgctgataatcgtcttctttctctcgccccggcgatcaataaaccggccattccaaaaatcgcaaacggcaggagccagctgatctgatcagataattccgtttggaaaaggcgcagcggaccaggagttcccgttccgaacattcctgaacctgattgcattttcgagccggtgcctgcaccgctttttcctccgccaccgggaccatctccgccgcttggaggacctccttgaccgccgcttggcattttcccgttagatggaggtgccgtcatactgccgttttgtggtttgtctccgcttgctgaactgctgcttgaagactggccgggcggcgcttgcatttgtgaagaaccgccggaagaagacatctctttcgatgcgtttccgtccggcccgccctggccgccgccggaactttgccctgtcagccgctgaatcccgttatatccgaaagccaattccaatacggagtttgtctggctgcttccgacatatggccttttgccggcaggaatattatcaacaatgagcggccatgacaatgaaacggctgctaaaacggctaacgcgcttaccaatgaaatgatttttttcttaatcgtggtgtttgccgcaatcatatagaacagcaagaaggccggcaaaatcatataagcctgaagcatttttgtgttaaagcctgctccgacgacaaaaaatgccgccaaaagccagatcagtctgccttttctgatcgctttaaagagaagccatgtggcgaacaagaggaaaaagaccagtaaagcatcgacattattcgtccgcgcgaccgctactgcgatcggtgtacacgccatgacaaatgaggcgatgcgcgccgccgtttttccgaacgtcggctttattaataagtacatgaatagaactgaacctacacccgccaatgcctgaggcaggatgacgctccacccgtgcataccgaatatcagcgcgctgatcgtttgtatctggtatgtaacaggcggtttatctaccgtgataaacccggctgcgtcaaatgaagcgtaaaagaaattatgaaagctttgaagcatactcgttaccgctgcggtgtaataaggattcaccgtatcgtcattccagatgttgtacatattcaagaatgcggaagcgagtaaaatgagaatgaagactgcgtctatctcgcgttttttcattttcacctgtgttttcactccttttgtttaactttgaacaagtgtaacaaccaaatgtgaaaaatttattaataaacaaagacaattattttgccgtttacaaataggtaaaaagaatgacaaaacgggtaaaaaagcaaaaaaaaagatgcccccgtcaagccgggaggcatctgtcatgatttctgatttactgtatcggtttcagccgtgcttctatttcagaacggcggtgttcgagataaggcgggagcgcaaccgttttgcctagctcttcaggtttttcatcaaccataaatcccggaccgtccgttgacaattcaaacagaattccgttcggctcccggaagtacagcgctttgaaataataacgctctacaatgcctgagttgctgaaaccttctttcgtaatgatgcggtgccataaagcaagctcctcttcattctgaacgcggaaggccacatggtggacgctgccttttccaggacgctcgcgcggaagatcgtttctttcaatcagatggacttccgtgcgcgcgcctccgtttccggattcgagcaccgtaaccgtgccccggtcttcatgcgtttctttcccgatttcagtgaagccgagcacatcggttaacacacgcagcgtcggttctgcatacgggacggtcaattcaacgggaccaagaccgcggaaagaatattcttccggtatgccgctttgcttcaccgcttcaccgatgtcttttcctttttcgtcagctgtcagcacaagccgctgtccttcatgatcccaaaaagcgagtgtctctctgcccgctattgtcatgatgtcgccatgagcgacctgatgctcttcaaatcgttttttccaatattgaagcgcttgtgcatccgggacacgcaggccgattgaagaaatactgtttgttcccgcatgaaacggtgcaatccgcggaatttcgaaaaacgtcaattccgatcccggattagctgtttcatcaccgtaaaataagtgatacatcgtcggttcatcctggtttacggactttttcacaagcttcaatcccaggatgttccgataaaaatctaaatttttctgcgcatcagccgtcaatgctgatacatggtgtattccattaactttcattatgttatcctccagtcaattatctcgatttcgagatattttatatatacaatttatgttatccggatcgcaaagtcaacccatctgcttcacagacggtctgcagactgtcgctccccaaataacgaaccttcgatattaaaaaaccattaatgttcgtttttaaaacggtattttttccttctcaaaagcagaaacctctatcttttagggaaaacaacaaaatcagaaaatttattttattcgcgtttcagcaattagggtttacaatatggaaaatagttttttcagcatgacgattttacatctggagggaaaggatatgcagattgaagagaacggacttaaaaaagagatcggccttaccatcgccctctcacttgttatcggcaccatcatcggttccggcgtatttatgaaaccaggcgccgtgcttgcctactccggtgatgcgaaaactgcgcttatcgcgtggctgttaggaggcattttgacgcttgccggcggcttgaccgttgcggaaatcggcactcagattccgaaaacgggcggactttatacatatctcgaagaagtgtacggcgaattttggggctttttgtgcggatgggttcaaattatcatttacggccccgccattatcggagcaatcggcttgtatttcggctctttgatggcgcacttgttcaattgggattccggctggtctaaattgatcgggatttcagccgttttgtttttaagcatcattaacattatcggaacgaaatatggcggcatcgtccagggaattacgactgtcggcaaattgattccgattatctgcatgatcgtgttcggcctttggaaaggcgatcagcatattttcacagccgttacaagcagcatgtcggacatgaatttcggcgctgccatactggccaccttgtttgcttatgacggctggattctgcttgcggcactcggcggcgaaatgaaaaatccggaaaagctgctcccgagagcgatgacgggcggactgctggtcgtcaccgccatttatcttttcattaactttgcgctgctgcacattcttcctgcgaccgacatcgtgaaactcggtgaaaatgcgaccggcaccgctgccggaatgctgtttggcgacatcggaggaaaattgatcagcgtcggaatcatcgtcagcatcttcggctgtttaaacggaaagattctcgcttttccgcgtgtctcatttgcgatggcggaacggaaacagctgccgtttgccggacagatttcgcgggtgcatccgacgttccgcaccccgtggattgccgtgtcatttcagatcgcgctggccattatttttatgatcgccagcaatcccgataagctgtctgaaatctctattttcatgatttatattttttacgtcatggcctttttcgccgtgtttatcctcagaaaaaaaagcggcggaaaaccgcgcgcctacagcgtgcctttgtatccgatcattcctgttttggccatcgcgggttcactgtttgtgctgatcagcacgatcattacagatacactgagctgcgtgctgtccctcttgatcggcctcgccgggctgccgctttatttttggctgaaaaacggcagaaaaaactgacaaaaacggttccttttacgggagccgttttttttctggcaaaatcacgtgcaaaagttgacagcaaattcacatcttttgttatactttttaagcaagatgtctgaattcgaagtatgttacgtttttttggcgaagtgggtaacataagaaaaacaggatgagacacgtttttacgaaaaaatcaagaggcgtttttttcgactttatctgttttttttcgacaaaaggctatataataatttgatgtgtgcattgtctcattcaaacaatggagggtttttaatgataaaaagaaaaaaagataagttctcactccttttaacagaaatcgcaaaaaacatagacgaaaccgcagaatactttgtcaactttaaagtgacgaaccagacgactttaaaggaatttgccgatacgttaaaagagtttgaaacaaaaggagataatcatgttcatgtcatgattaaagagctgaacaaagcttttatcactcccattgaacgtgaagacatccttgagctgacaaacagcctcgatgacgtgcttgacggaatcgaacatttttcagcaatgatggagattttctcgatcacttcttccgatgagcatatcgataagttcagcggatacatcagagagtgcgcgaaggaaattttaatcacgattgaactgcttgcagaaaaccgattgaaggacattcaccctcacgccattaaaattaaggaatacgagcacagctgtgataacctgcaccgtaaatcattaaaaaatctgttcggcacagaaaccgatccgattaaagtgattcagtaccgcgaaatttacgaaacgcttgaggaaattgccgactcttgccaaagcgttgccaataaccttgaaaccattattatgaaaaacgcgtaacgaggggttataatggatactctattacttttaacgatattaattgtcatatgcgctttggtatttgacttcattaacggatttcacgataccgcaaacgccatcgccacctcagtttcgacaaaagcgctgaagccgcggcacgcaatcgtcatggctgccatcatgaactttctcggagcgatgacatttaccggtgtggcgaaaaccattacaaaggacattgtgaatccttatacattagacaacgggtcagttgtcattctggcggctctactcgccgcaatcgcctggaacttgatcacatggtatttcggcattccgagcagctcttcacatgcgattatcggagcgatcgccggagcggccattgcagcgtcaggttttgcaacgcttaattataaagggttcattaagattctcgaagcacttattttatcaccgatcatcgcctttgttctcggctttatcgtatattcgatcgtgaagctgatttttaaagacagcaatttggcgaaaacaaataaacgtttccgcagagtgcagattttgacggctgccattcagtcctatacacacggaacgaacgacgcgcaaaaagcgatgggtatcattacgatggcgcttatgacggccaatttacataaaagtgatgccattcctttttgggtgcagctctcttgtgccctggcaatgggtctcggcacatccatcggcggctggaaaatcattaaaaccgtcggcggaaaaattatgaaaatccgtccggtaaacggcgtatctgccgacttaaccggcgcagccattattttcggggccacgtttattcatctccctgtcagcacgacgcacgtcatttcgtcttccattctcggtgtgggcgcttcccaccgcgtaaaaggcgtaaactggggaacggctaaacggatgctcattacatgggtcatcaccctgccgattgcaggtacactcggcgccatcgcctttttcatcctagatctctttttctgatgacatccgcttctttacagaagcggtttttttgtgacaggaaaatgatgtcatgacatagaatgaacatagcagaccatttttcaaattgtgagggatgctcatgcttatgttttttcagattatggtgtggacgatggcggccgcactcattttatatgtgtacgcatcctggcggtatgaggcaaaggtaaaagaaaaaatgtttgccatccgtaaaacgtggtatttactatttgtactgggctccatggtctattggacatatgatcctgaatcgctctttgccgcatggagacaatatttgattgttgccgtctgctttgcccttattgatgcgtttatctttttgagcgcgtatatcaaaaagctcgccggcaatgaattagagacggatacgcgggaaattttagaagaaaataacgaaatgcttcactcctatcttgaaaaactgaaaacctatcaatatctgttgaaaaatgaaccgatccatgtatattatggaagtacagaagcttatgcggaaggcatcagcagactgctggccgcttatgccgaaaaaatgaatgtcacggcttccttgtgcgactattccgcacaatcggataaggaccgcttgacggagcatatgcctgatgcggcggacgttcagtcccgtcttaaccgtaaagacgtctactatgatcaaaaaggcaggcttgtgcttattccgtttacagtccagaaccgccattacgtgatcaaactcacgtcggaaaacctgttgacggaattcgattatttgcttttcacatcgctaacgagcatttatgatttaatgctgccaatagaagaggaaggtgacggttaaatggagcaggcatttcaaaacgggcagccggaacaaagagcgaaaccgttcaaaatgtttaaaaaacgttcaatgacaagtatcgcaagttaccaggtcagccctcataccgccagaattttcaaagaaaacgagcggctgattgacaagtataaacaaaaaaaagcttgattacactaaggacaggagacacggctcttgtccttattccttttttccttatctttcatataataaaaccaacaaagagatgcgacaggtgatgatgtgaagaaaattgtcaggcgcgtaaagtttgtggattacggacgcttcgggctttccgcttattcgctgaggatgcgggcgaggaatctcaggctattgaaccggttaaaaaagaaaaaaggctgaatcccgcaatgtgaacgggactcagccttttttgttaaagctgcatcagaattttcgcttttacagcggggccgtagacgccgtcagacgtcagtccgtttacagattggaagcgggccacggcatctgcggttttcggaccgtagataccgtcaattccgttattgacagctcctttttcaggatagaaataaagcgcggcgagcgcgttttgcacctggtataccttttcgccggacgtgtacggctctgtcagctgaatcacctcgtccggaagagaatacagtgcttcaaccggcgggctgacgatcagtacttgtccgactttaatcaggttcgggtcagcgatgttattccatttctgcagatcggccacgctgacgccgaatttccgcgcgatcgccgacagcgtatctcctttttggacggtatacgtctgtctttccccagaaccgattcccgctttaaactcatcccatgtatccaacagtcttctcggacaaagctttcctgaccaatgcttgtgcgcaacgacatttgcaagcgtgatgccgtgagaggtcattaatgtgcggatgagccattgggcgtttgccacggcctgtgaaaagttgccgtctgcgttttcacaaatttcaataccgatggatttacggttgccgtccccgtttccgtcaccggcatgccagccgctttcgttcagcggaagatgctgataaatttccgtatcatcgactgtgaaatgccagcttgtcggtgtatcgggatttttcacatagcttgcgtgacttttggcgttagctccgactgcggtattggctgtattgtgcaccgtaatgtaaatcggtgtcattgcatagcctgggcggttattgtttcctgccgggataaaatcctgtgtgatttttaccatattctcatctctcctatttcgataaattgtttatttttaataaagcctgctgttttttcccttttgctgtaacgtaattgtttttaaaccaggcggcggcagtcgttatgattgtaaaaacggccgacccggcggcatacagcgtatctgcaagctggctgacctggtcctcctgaatattcagcggcgatttgccgaacatcagcaaagtttgattcaataaagcaagcaaaagaagcaccgtcctgacgaccgtgcctttgtccgcaaatttcatatcggtttcccccttacttttgcagcagattgtacatgatggcgatggctccgccaatgacgcccgtgcagattgctgtcacgatcgctcctgtaatggtccgcttaatccatgttgtgttttcgtcaattttgttcagtttttcgttcagcgtcatgatttgctgatcctgccggtcggatacccgctctaatacggccacccgctgttcaagcaccttttgttcacctttgatgcctgcgaattctttttgcaccgcttgttcatccagaagcacttcagctcccccctcttacattgttctcacctcccttcggaagcttcattcttacgaaaatgccgtgcctttgatagaaaggctcccgccggaaatgcttttgatttccatgacgatttccttaaagccggcaatatcaaatgaccacacttcttctgtgcctgacgtaccggcggctgatgtcccgtcatcagacttgattcctctgatcggcacgttttttcccgagatggatctcccccaaaacgcgacatggcccgactcagccgtgccggtgatttcgacgagaagttttttccaagcgcccgccgagaagatgcttccctcgcccgcctctgctgcattttcatgaaaaatcacgtctgtatatgaaaacgccatatcaccgcccgaaccgacagattggtataaaacaaattcggactgcttttgatttccgttttcaaaacggaaccggtaatatcgttttgtcaggcagacccaccccgaagcggtcagcactccgccttttactgcgacagaatgtgaagctgtccacgaattgttatcctcgctctcttcgataaaaagagttccgctgcggtccgaataagcccacccctgtgctctgtttattaagacggctcctaaacggtcttgtccgaattggctgtaaacttcaatcgcttctagcggcgtattggtaagaagctctgccattccggacaaatcagcaaccggtgtgacataatcgtttttgttaccgcgataagcttttactgcgccgggtctaccaagttgatcggcgggaaattcaaatgaatgctttttcatcggccgtcctccttttctcatttactaaaaatgacaaataaaaaaagccgtttggcttatgacacagcatttttataattttcgtatgtttcacccgttatttcttgaaattcctcaggcgtgatatacttcgcggccacaccttcagccagatcttcggcagagcagtcatcatagcccatagcctgttttaccatttctattgtggcccacttataaaacaaagcgtaaacccaaaagttaagtctcttcattttttcattctccttttacgtttaataattctaattttaaagacgctaattgcctgccgagtgactgctgcgcttgttcggctgcttttctggccaatttctcattcgccagctgtccgccgaggcctgcaagctggtttgaatcgggagccgtatctttttttaagctgtctttatatgcttcgtcagccgtttccacccattcttgtttctcttcatcaaaaaatgggcgccacatgccttcgccgtttatttccggaggaaagtccgcagcgttaggcggcatcatataatctcctgtctcagaatccggataaagctcaatcggagtgcctgtataaatgttgtcattgtcatacggaaatattaatttcatattctcgctcctttacgtgagtgccaaaacaaggtcaatataataaccgttcacgttattttctatattggccataattcccgtcagcttcatatctccattagaataaataataaatttgctgtaaccggtggtgccgctggctgcaaccatcgtcacaacgcctttggccggcgcacaagaggatggcacactcccgaataccacttctctgtccgtaagaacgtgtccgttcaggtgaagggtgtttcccactttgcggtattgaagcggcctgtctcctgatttagcgccatttttataaggaacatttatccaaggtacattctcagtatcaagttcagtaatgaggcgacgccagccctgccagcccaagttcaaatccaaatagttcgtgaacatattatttttataatcaacggcaatgacatatccaaacgttccctttccttcactgtcaagagaggtaaaatgaaacatgccgcgggtcgaagcgttgctcggactgtttgccgctttgccggttgagtaaaaggtgccgaacgccctgccgtttttaacgattttttcaagaaagttatcatcatcaccaattgtaagaagatagccgccgttatcgtttgttattttcgaaagctgtgcgccgttccagatatttttatccgcctgtgtgacatggatgtcttttttattagcgtgagcgtctacttttgcttgagagcctgcatctgtttctctttggctccattccgaccatacgcctttagtgctgaaacttcggacgtatatgggatttccggcggtcactgtgtctataaacatttggacaaacgtcggtgatgctccgcgggttctttgcattacaattaattgtccgtattccgcaggcttattttccgtatgctgaactgatatatagtagataccggacgtttttatattgtctaagtttgtttccgttaccgttttagcattcccgtcattgtcagtcagattgaataactgccctgcattccatttgtctttgtcagacttggttacatgaagatctgttttgtcggcatgctcatttacttttgcttgtgctccggcagctgtttcaaatggcatccattccgtccagatgccgtttttcagcgtttttctccaaaatcccccgtcatctgagaaagcggccgcctctccgttattctttgaagaataaaggtatataccctctgacggtttaggcggggtatttactccagttgcagccgctgagaaagtaaaggtcttattctggctggcagcggtctgatgaaaatcctgtccgtcagagatatcaataaaagcggagccattatcttttgtcattttagacaattgcccgttattccacttctggcgctcttccttcgtcacatgccggtccagatcttgattgtgctgatcaaaatctttctttgctgcctgctggacattgtctacgtttccgagaccgatttgcgcctttgtcgttttgtgcgggttgttcatgtcgtttttatgggccgccagatccgtgtgtgcgtcatttatgcctttttcccagcggttgacgtcatcttcgttaatcggatcgtccggaagccagtctgttttttcttcgtaagccatcgttacaccacctcaaaggtaaatcttaaatcaagcgttctgttattactgagatctaaatttgtttttcgttctgtgatgacgcttcctgtttcgtcaagcatctgcacggtttcaatgtgtttgacgtcttcttccctgcgtgtgagaacggtgactgcggcatcttttacggaaatgtccgcaatcggagtttcttttccgtttaacagcacttttgtgatcctgtttttcagatcggctgcggcacgctgtctgtaagcggctgatatcatggtaagaccacctcgttattgttgagtgtgacggaataaccgaccttcagttcactgacttttcggtatctccgattgttgagaatgacccggtctttgatttccagtgtttcgtttaatgcggctctcagtgtatacgccaaatgagcgggtttgattttttcaagcgtttcaatcagctcgttcatgtgctgcaggtcatcaagcccgatatcggcataaaaacgatactgccccggaaacatccgaacgtaagctgacggatgttttaaaaaacggtttagcgcctgctcgatcgcttgatgtgtgatgggcggaatattcgacatcttggaaatcagcctgagccgtctcatatcctccgtgtcacctgattcccgcggtatttttaatattttttcccagcggtcaagcccccacgtcgccgtcgtgataaagagctgatctgtcaaatcgaaaatatcgttattctgccgctcaaactcaggagcttccgcctcaagcagttgtgccatctcctttaatcgggttaaaaacggcgggaggtacgccgtcatctcatcgagtctgctcaaggattgtcacctctttgagtttaggaatttccacgtcactgagcacgaggttttccgccgcaccgttcattttgatatcggcgtagtcactgacggatgccgagttataaacgatgttgtttatttgtgataaacggacggtgttttcttcgaaggccattttcttaaataaattcaggacgcctttttcaatctccgctttcacgtcatcgatcgagctgttcagctcaggcagcacggaagcggagatttcgatttccttccatacggcgctttccaccgttactgccgctccgatcggcgcctgtccttctccctgcccttcgtccggatcaatataatcctttactttcttgatcagaatatttgatgccggttccaaattcgcatttgtgatgacaaccttcaccgttccggctccgttccaaagcggaaagattttcgccctgccgacgccgtcaacctcttcggcccattgtttataatgctgtttatttgcgctgactgcctcccggcggacacgggtaaaatagcgcgtccttaagctgctgtcatcttcttcttcacggccgggaattaatatatcgcccatgaccgctttctcaagcccgggaatcgtatcaagcggcagcagattttgacctgtaatgccggcattgcccgcttctccggccgtttcacactcgagcgttccatcctccgtatattgaaaatacaggttatcaacgaagaaacgggagcctggcggaatggtgatgcccgctgtgaattctccggctctgaccgcttttgtggcaggtgttcgttcaattcccgcttcagcagcccgcctgtccagaaattctccctgagccgtatcggaaaacacgagctccagcacggtatcaagccaaatataagactttgcgagctcagcggccgcaggcgcgagcgcattgtaaatgacgctgccttctctcgtatcaatatctgccgtaatgcgcgccagcattctgtccataatgtcgtcaaacgtctgagcttcaaacatcctcacccagcacctcctctatctcaagcatgccctcatcagtttcaacggtaaaagagacggtgaaggcatcatcttttttctcaatctcaaaattggtaacagccaaaatacggtcatcatacagcaaggcttcttctatcagtcttggaatctccatttttttataagcatccgtcgtgttctgatctgaaagcacttcctgaagttcgtttccaatatcatggctgaaaaccgaatatgaataccgttctgtgtgaagagcgatatagacgaattgtctgattgcgtccagtccgtttatcagttcattggtaatccggttgttttcaaaatcaattcggtaggtttgtgaagtctcaacggcctcactcgcatcctccaaatcttcaaattcgatttccggtgtcagggccattgcacccgctccttttagatttgatcatgtaaaaaagccctcttcggatgatgaagcggctttaataggctgatattctggtacagttccgtccgaatgccggttaaattttgtccagtacaaagaaagactgtcctcctgttaaagcggcggtcatcacccgatctcccgcctggagctgatcatcttctccggatctcagccgcttcggtacaatgagtgcatcagacggaatcaaaagtttgtcgtgatctttcagtttcagctcgagcggcgaaacggaggtcacttcggccggcatcagctccaccggcgcttcggcgtcaaccgctccgacggctaaatgtttaatggcatcacttaatctcatcaggatgtcccctccggaagtgaatttttctccgtgacgtcaatcgtcatggtatgttttgttccttggaattcatggcggtccgtatctacataataggttttcttcagcccgatttccggaattgagatatagacaggcaatccgctttccaacccaggaataccgatcgcctgtatatttttcagctctttcttaacgccttttttctcagcctgcttcacttttgcgcgctgtttcagctgggcttcattaatgtcgtcagaaaccgtttcggtatactgcaaaacgccgaatgttttcatgcccgcgctgtctgacgcggaagcctttatcgttttattgtctttttgcagccgcatgacgacacgggttgcggtgtcatcaattgaggtgctgtattgataccctgtgatattaactcctgtttccagcacccatatgtcagacggctccggccattcacgcaagccgagcctgcctttttctgaatagagctgataattgcgccccgtctggctttttgtctgctttaacgcttttagcatcatatcgtaaaggcttgtatcatttttaaaaacgagtgatttaatggtatggcctgtgttggcaatggatgtgacgggaatttgaaaatcgctggcgatccttttcaatatttgatcggcgcgcttgttggaaaacacgtaaacgtcctggtttttcacaaggtattgaagcatatcgtatgcggtgaaggcgatggtttgctcatcgggcgttcttgcaaagacaatgccgcggaatagttcttttccgttccatttgaacaaaaccgtatccccctctgatacaccgtaatacgtctggctgccctgctttacgacaatcgtcgcttcgatggagcggggcgcctgatatctgtgtccttccagcgttacgctttctgtgacaagctcgagccactccgtttcttttatgacaaatagttcaatcatcttttcacccgtttcattgcggtatcttcagcttctgccccgggaagatccaatgccccggctgccggatattccttttgctgcgcttaatcatggcggttttattcgcgttccagattttccgccactccgtgtgttttccgtaaaacttaccggcgatgtcccaaagcgtatccccttttttgacggtatatgttttgggtgaaactttggacgggcgcttcactttcgtttttttcttttgtttgatttttcttggcgaagcggttttatattcttttagtacgatatcaaaattccggtcgccgatttcattgtcaccttcgctgtaattgaagctttcaatgctgcatgtgacattaacttttgttcctgtaatcaaaaactgaacgggttttttcgctttcatccatgcttcaatggctgaaatggctttttccggcgaagggatgctttgatattcggcaatcgggctgtaccgtttcggaaaaaaagaagagaacgaaatttctttcgctcccagttcttcgataaacgtcacctctccaagtccggtgactttcacggaatcattctgcacgctgtttgcgatatcaatcgcttcagggagaacgggaagccggagcttgtccttcccctgagacagccaaaattcgtaaacagatttagtcaaaagcaacggccccctttgctccggtataaatgtctttttgcagttcatcaatcagcgcctgtttgattttggcggcgaggctgtcggcgtcctgtccgttatggaaatgctgatcgccgctgaattcgattttaatttcttttgttcccattttttgaacggtttgtccgccgcctttaacggctgcggaaaccgtgccggctgaaagcgccgccggttccgtctgggacggatcggacacttccatgccgagcgcttgagcggcttgttgcagcagataacggccgcggatgccccgctcttcagggatgatccactcccgtttgttcccttcgccgacacgggcgatctgctccttggtaatcagacccccattggcataaccgacgtaagggcctccatgagccatacttttaatcccggggacattgctgatcgagccgtatcggcttttaatatagccgatagcggcagcggcgttgtgaattggatttctgatatcattcatgcccggcgctttgtgatcttcaaaggtgctcggaatcgtctgcataagcccctgtgacgggtgtccggctttggcgttgctgtcccatagattaatggaattagggttgccgcctgactcatactgtgcgatcgtcattaatcccggaagccagctgatcggcgtattggttgctttcattgcggccaaaagccactctttgacgcttcctcccgctgcacccatgccggaaaaggctgctgcaagcgagcctgcctgtttttcggcgtattttttcacgtcaactgagccgagccctttgacgacgccgactgaagcaaagcgcccgaggctcatcatgacacgggaaggagagtgaatatcaagctcttccctgaatgcgtcctcgacttttttggccatatctttggccgcctgtttgacttcgcttccttttgcagtcatccctgatacgaagtgtccgatcaggcctgacccccagccgttcgcggaatctcttgattgcacaaacggtttattgatatgtgtgcttacgtattgcgacgttcccgtatcttttgcattctgtccggccgaatatcctttcaccgttgcggcgccccatgatgacgattgattaaccgccgattgataaggtgttttcaccttcgtttttaaaaatgaatcggtgcccgtcggtgaagtattctgacctttggcatagcccgcaacgacttgctttccgtaaccggatgaagacgaaatgagggtattgaacggcgctccgatgtttttttccttccagccgtccatatccaccgcttttttgctgattccgctgtcaaagccttcagtaaactgtttgccgagtgatgaagccgtcccggcaaatccggaagaatccacagacgctgcggccgatacagatgcagaagaagaaacaccgcccgctcccgccggtgcagcggaagactgggccgaagccgcgcccatatcatcgacaacacgcatgccgagcttagacgcagcttgtgaaagcagcatctttccgcgtccgcgattgttgtcaacgggaatgacaaattctttaccggcttcaccgatccaggaaatggtcggctttgtaatgtagccgcccgtggcgtttttgtccgttttctttttatctccgccgcctcctgtgacaaagttcattatgcctgaaatcattttgccgccggttttatcccaaatctttttcacccagtcgaatgctgcagaaaaagcatctgatatggccgttcccacttttacaagaggttcttttatatgtttctcaaaccagccgcttaaccctttccatatattctttaccgtatctaaagcagtctggaaagcatctgatattcctttaccgacatttttcaccatgtctttcaccggattccagacagtatccatgaaccagccggaaaccgtactgaaaacagatttaattttatcccaagctcctgtgattttactccaaatggacgtcgccactccgacgacagccgattttacgggcccccataccgtgctcataaaccagccggatactgtgctgaagacaccttgaatcgtcgtccacgcattcacgatatttgaccagatgctggttgccactccgacgacagccgatgaaaccggcgtccatacattttccatgaaccaggatgacaccgtgctgaaaatcccttgaatcgtcgtccacgcattcacaatatttgaccagatgcttgtcgccactccgacgacagccgatgaaaccggcgtccatacattttccatgaaccaggatgaaacgcttccccaagtatcttgtattgttgtccaagcactttgcgccgctttggaaatatcattccacgtgtctttcaaagctcctgaatcaaaggcctctcccaagctggaaccgcctaaactgccggcgatgccgcctaccgcgccgccgattaatgtgcctactccgggaacaacgctgccgattgccgctccggccgcggctccggcaagaccgccgcctgctgagccgaccttctctcctgcattatctttattgatgccggctaaatcagtaagtgataacaattcacctatgccgggaattcctttagcggcaccttttaaccctttcataccgccttttagcgcctttgaatctcccaagcctttcaaaagcgcgccgatgcctttacctgccccttttgttttcggcgtgtttacggatgcctgtttgctttcctttacggaggaacctcttttcgaggatttatttcgcccttcgactgtactgctattgcccctcgtcactccggtacagcagcagcagccccccaaagccccgccagttttttttgctgactttcctgaagattttggcgctgttaccgtgcgctgtgaaccctttgtcagatcaggacgcttcgggccgttggagccgccggcagtaaggccgcccttactcttttcttttttcgtgccgcctcctaataatccgccgatattgagtttgcctaatttttcagcgattcctgataatattttttctattaattccccggctttttcgatgattttgtccgggctgaatttctcaaatttcttggcaatcttgctgacaattttatcaacaaatgcctcggctttttcgatgatcgcatcaggactgaatttgccgaactttttatcaatgcctccgaacagtgaggatgtaaactgctccactttttccaaaatcttatccggattgagaaaatcgaatttctcagaaattcggtcaatcgtgtcatttacaaattgttcggcgcggtcgattagcttatcaggactgaatttgccgacaacgtcgtcgactttcttcataaacgaatcagtaaaatgatccagctctttcaatatggtctccggactgaatttgctgacaacgtcatctatctttttcataaatgaatcagtgaatttatccagttctttcaatatggtctccggactgaatttactcacaaccccgtctacctttttcataaatgaatcagcgaatttatccagctctgctaaaatcgtctccgggctgaatttgcttgcgatttcgtccacttttcccatgaatgatgttgtgaacttgtccagttcggctaatatcgttgccgggctgaatttgcttgcgatctcatccacttttcccatgaatgaggtcgtgaacttgtccagttcggctaatatcgtctccgggctgaatttgcttgcgatctcgtccacttttcccaagaatgacgttgtgaacttatccagttcggttaaaatcgttgccggactgaatttgctcgcgatctcgtccacttttcccatgaatgacgttgtgaacttatccagctctgccaaaatcgttgccgggctgaatttgcttgcgatttcgtccgcttttcccatgaatgatgttgtgaacttgtccagttcggctaatatcgttgccgggctgaatttgcttgcgatctcatccacttttcccatgaatgaggtcgtgaacttatcgagttctgctaatatcgtttgcgggctgaatttgcttgcgatttcgtccgctttcttcataaagcttgcagcgaatttatccagttccgctatgattgtttccggataaaatttggatgcgatgtcattgacttttttcatgaaggtgtctgcaatggagtcaagcattgaaaaatcgtttttcggcgaagcaggagcagcagatacagaagcttttccgacgtccggcatattcttttgcattgcagccagctgtgctgtcaccttttcgtttaacgataattgaatgacattgttttttcccgtcagcgaatcaatgcccgctgaaattcggccgactgttttcatgacgtgatctatgacgcgtatagtgacagagtacccgttctttaacgcagattgcatatagcgtttgatacgttccatggcaggggtcacttcgtctgacgcatacagtgaaacggtaaatcctttaaaaccggcagccagatcccgcaatctctcaaatgccgctgtcgcgctgtcttttgctcctattttaatggttaaagacgcaggcagatccgctaattgggcttgcaccttttgaatgacggcactggctccgtcttcagctgaaatagagatcatttgtgcgcccagctttcttttcatagagcgctgaatgcggtcaattgttcttaaaacagatttactctctttgcgtatatcaatttcactttggcgttttgtcattttcctgtatttctcaagcgctctgaagccattttggattttccttattttctttgaaacccgatcttccaattcaaaacgggcggtcagctttgccatgatgtcgctccccctttcttcgcttgtttttcaagaatgtccagcttgtaaccgattaaaccgtacaacagcgccttaaaatgtctcggtgcttcatataactctttcagttctgatggagaataatgaagctcatgcatcgcgtaatagagatacacggcttccttattcccatcttttatcagttttttgcttcttgctccagatcttctaattcatcttcaaaaccattgatctcaatcgctttattcagccaatttgcatactcaccgccgactgaaagcacgcgttttgccacctcgaccggatctgccgttttgtaagcgtcgcggagctccttagaccggaaatcagggtaaatcgtagattcaaccgcgatccgcgcataaaagcgctggctgtctaagtcttttactcggcctctgcccttcacatttttatatgtcgtgctttccttctccagttcatcaatgcgctcagtcgtaatggctttaaaaataaaaggcacgatgtttccttttttatcgacaaaacgctttgaaagcggaacccgaatctcctcagcctcgactgttttacccggcataaagaatgatagatcatatacttgttcgtttttttcgctcatgatgaaaactcccttactcttttttttataaaaaacaggcctgtaaaaaggcctgtttcactcataccgatcttaattaaaacgtttcagaaagcttttccggcacatcgaaatcttcaaaggtaaacggcacttcttcttcgagtgcttctgagtctacgtccagtccggcgatttttgcagaatcaaagttgacgtcatacagagtaacgcgttctgttccccggcccgatgatttgtcatcaagaacggcttgcagcgtaaaatacgggtcgctgccttttttgacgtaatccatcataaggactgcgaatttggatgtgaccttatagaatgttgccgtgcccgttccgttggcgcctgttgttttatgtcccgtcatgcggcggcccatgatgtttacttctgatttgtttttttccacgtttgcttcaaacgttttaatatgcgccatctcttctccgtcgagaaataaacggccttcttttcctgaaatcgtgttttgcgcttttaatgccatcttagtttacctccacgttaaagtagaatttttctgccgcatccacaggctgtacggcgagatcgattaaaaagccgtcgcggtcttcattcagcccgattgtaatgtctgtatctgagtcaaaatttgcgatgccgcccgcatcctgaagcgtagtcaaatattgaatgatcatcgttttgacgaattgaaggccgtcatttgtcgcaggaagatcgctgcccgtgccttttttcgatttaattaaggctttcagttctcttgtcaaatcgttattcaccgcatcaagcacacggacgattttgtttttcgcgaactttttgtttttctctgccgtaaatgtcaccaatgagttgatatctttttcaacgctgactgacttatcacgggcatcataagagaaaaggaattcacctttggaaagacgttcgatcacttcatcatgagtcaggcggtgcagcacatcgacggcgccttcgtattcaacgaatgttaaggattgattaaatgcggcgctggcacttgcgcctgccacccaggcggtcgcatcttcagctttaatctcggttccgtcttccagcagcacaccttcagtaacattgataatgccttcataatccccgctgtaatgggcggtcaccccttgcactttctgtccctgcgcatcgcgaaggcgtttaatgaatgcggcaaatgtcgctttcagctgatcgttttccgcgacaggaagagcgatgacatcgaaattctccgtttcagcagcagctaaaaaatccgtatagtctgagttgaccggtgctttatcagttccgcccgcgagacggatgcctgcctgcgggtttaacttttccccggattcttcctcagtgcctgtcagcgggatggaagccgacagttcgcccgttcccgtaaatgtgacatagccgtttgcttttaattcttcggcttttttcaccgtttgtttgtcaacttccgcttcatccatgtaagtggtcacatcgaaagcggtctgatcaaggacgttttcactgatgcggatgatgatgtcatttccttttgaaccgccgtacaaagcggttgctttaacaccttgtgaaagatcggcgctcgctctgattccctctgtcagacggtacatcaaaacggtttttgctttctttttcgcctcacgaagcagaatcagtgacggatcttcaatactgagccccacttttttattcaaatcttcaatgcttgaaatggaaacgaatgttttcgcttccccccagccggatgcgacgggaagggcgacaatcccgcgttcaccgatcgatacccgctcctgggcggttgttttaaagttaaaatagatcccggcacgttctttttcttttccttgcgtaaatgttccgccgttcattattgcatgacctccttggttaaaaatgcttcaatgtaagacttagcttgcgcttttgtcatttgtttttgcttcacgccgaataaagcaccctggagaatctcgggttttacgccgaaaagctccttcgcgtgctttgttaaatccgccgtgtcataaagaaccgctcgttccgccgctgcggcgtttttctttttatattgtttcacttttctttcaccccgctgttaatgtccacatcccgcagtgcgggagatgtttgtttctgatagtagtagcggctcgtccagcggattgtgatcactgcctcgcctttgtctccgactcttgtttcgatacggctgatgcggacgaaatcaccggtatcctcccctgattccgtaagcagcggaatcagctgtcttgattctctcaccgcatcggcgatccggtcggctgcatagagcgcctgcaccgagtcggcatggaacagcttcacattcagactgtatgtcttcttaaaggtggagactgtgtcattctcgtcaaaaacatacgggggcggaatgtatagtgacggcacctgaaattgttcaggcagttcattttcatatacgggcacgccgcactgctgatacaaaaaagcggcgattgaaccggtttcgcgattcatccgatatctccccccaacgtgttaagccactgattgaaacgcttgtccagcgattcggcgaagagtgtttcatacaaaagaagggctttgtcccaaaacccattcccgctgatccactgttttttgagcgccattcccgttgaagctgacggatcatagatgaaccgggagccttgaaaatatccgggcacccatctgacattttcatctgagacggtccaatgtccgtcatttatgaatgaggcatactctacattggtgccgatttcaagggtcagtcccccgttttcaatgatccatacatgatcctgcgctccttttcggaaagaagacagcaggttttctgtatcaattcctcccgaatgaataagctcctcccgtaccatgtcgagaaaatcctctcctgactgttccagccattcgcctgcctgacgggcaaattctccggatgatgccttttgcagcgaccgattccattgttcaaggttttttatgctcatagtctgtcatctctcacagcgataacctcccaatggtgctgtcttgctttcttcggcatttccagaatatacgcctgtccttcccaaatgattttgtcattgacacgcacagcggcctctttcggaaaatgaacgagaaaccgctgatataccttatgatcaggcgcaagctgaataagctgctgctgtttttcaacaaacagacacggcacgtcttcagcatcgggcacttccggataagaaaagacaggctggagcttttcggcgggaatcccgaagcgtccggccttcggaactgacaccgtctcatgataaatatcgcatctgtcagtgagcagcccttcgtagctcataaaggtctcacctttgcgtttgcagaaaccggggaataacccggcgcgatatattcacagagcagatggtgcaccgccggttttctgattccgccttcacctgccaccgtatacgagtagccgcctatcttttcagattgataggcggaagcggctgcttcattctggttgatcagcgcaaaatattgagaaagctttaataacgcaagcttaatcttttcgggaagcggtgagtaaatagggtcagtgaacgaatgccccgccattcttgccgcttccgcctccgcctccagaatgtcctgtataagaagcggctccggcctgtttttgacttgatcataaactgaatatgaaacaacgtcagacggctgaattaacataactgccacccccgtcttattctttaacgtttacgattttggcgcttgcatcttcttcttcaaatttgctgtcaagtttagccgtcagtacgataataaatttgcggctgcgaatatctttatctacttcgattcggatattccgtgaaaaaccgagaatgatattttttgggtgagtcaaaatgatgtcagacgcatcgtattgggagtcaccttctccgaccgagtacggctgcagattggacactcctttgaccggaacgccgaatgctgaagacaaaccgccctgcaccgcaagatcccccaggttggtctgacggtcagccacacggtctttccattcaatctccatgccttgagatgtgtaaaatctgaattcctgaggcaggcgcaaatattttgccggaatggcttttaagccttttttaaatgtggctctggacagctcttccccgtttccgtcaatgacgtgagatacagtctgcttacggattccgtcaagctgtgccaagtacggatcagaagaagatgtatcgccgtttacgacaagctcctcaatatcgactgccgcccgctccgccaaaatctgcatgatcgtctgctgcaggccgtctttttctatattgttttcaagcgtgtcataggtgatattaatttccgcaatgacttctttcgtattcagctgcaccgtacttgttgccgggacggtcagctgatcgtcagttaaggcttttccttcctcagcggcacgcagaatccgctggccgaaaccgattttttcaaatttctgcgagtcattttccatttgaatcacacgcgattcgctgaaaatggtcggcgtgttctgcaccatgcggataaatgctgaagcttgtgcggggttcattaaaccgccgctttttaaagcggaaagtgacatttccgcctttctgatgatatcttgatttctcactctacagttcctccttctgactgggcttaaagcagtccgctccaaatggattttttaacaggctcttggccgcccgtctcttcttccggctgctttgatgcgcctcttactttttcaagcgcttcaatgcgtttaataatcggggcgagcatgtcctcaacaagcgttttcagcttttcttcatcagacggcgcagccgccccgtctttgtcttccgtgttttggtccaagctgtcaagccgctttaaaagcgggtgcagcgcgtgttcaatcgattctcttacgtcttcttttctcatcttgttcaagtcctctcccttgcggtttcttgatttgcggtcacggtcgagaaattgcttgaccgcgccgaataagccggcttgcttttctgccggctcttcgtaaacgtcagcggttcccgccatgctgtagcccgtaatgataccggctttaatctgatcccatacttcatcggaagctttggtgacaagcacccaagatcctttccggatcacagcattcccgatttcaaagtcatccggagcgacgtacgactctaccacctcgccggtcccgccttcaaaattatgatttgtatcgatgttgcgggcgtccgccaaaaaaccgtgggcggccttttcaatctcttcagccgtcatataatcaccatgggcatccgggacatccggctcgtaaacgatgccgtaaacaagcttctgctcatccgattcgttttttgtaaacacctgcacctttttttcaaatgacggaaggcctccggctgattttgtaaaaaagaattccgtttggttcgccgccttatcgacatagctcacaaaactgatgacggcatttctcaattctctcggcacgagatgttttcaccccctttcaggattgctcctttttccctttcagcaccggccggctgtagtactcttcaggccattcctcaagcgtcttgccgagcactcttccggccagatcacggaggtcattaggagagaccgcgccggcggaaataaatggcgtaagcaccttcgcaatttcaagcggatcgcgaaaatcaggcccttttaatgtgagctgtacatcgtggagacccagttcaggcaaaaataacgtgttgagcttattaatcagcgttttccgctccggctgaaacacctgctcctccgttattttccgtgccgtatcggcggtggctttgttgtattcctgcgcctcgcccgtataaagcggcgggagacggaaagcggaacggagtttatttctgcttttgtcgtcatattcaagaaacagcgcatcatcctgcagaatttccgcaagtgatttaatttccacagacacgggcgtaatgtcttcgcctccgtgaaggtctttttccttcgcaatgccttccgcctcaatcagcagaaacttgtgggcgttttccaccccttccaggtcattcatataatcctggagctctttgtacgatgcttctgacagcatgccgttttcaaccgtaatggcggccggcacgtgacggccctgcttgaaatacataaaattcagttcttccgctttccgggcgccgtacagattgacgatattgccgacccagcgcggaattccgtaagtgccgctgccgatttttaagtgaatggcttcatttgcccggtattcttcagacagggtctttacgtattcgccggttctcatgtccatcatgcgggggtcgccgtattccttaaaaaacactttccgaccgttcagcatctgaacatatttacggaaccgtttttgccttttaatcgttttggatgcgccgttttcttcatatgaaaatgtgacttcaacgggatcagtcacaccgcacacgcgcatatgtttcacatccagatattcaatccccgctggttttcccgccccgtcccgaagcacttcgagaaaaccgttgcccgttttttcacggtcttctatcgcatatccgaggatcgtctcggccgattcatcaaaatgaagacatttgtaaaagctctccagcttcatccagtttttttcggcccgggccttttttgacggggagcaatccgggctatttacatcaaaggtatattccacatcaaacccaaaacccgtaatattgacccgatacgcgtcaatgcactgctgaagaatcgtcgagtattcggcgattgttttcagttcaatgagattatagggcggtgaaatgatgtcttcgccgtacagatcggcaaattgatcttcgttcatctgccttgcctgcggcgcggccatttttgatttaaagacggtggctctaacgttttgatagttcggcaacgcctacctcctcctttcccgattcggacgtcttcgtttttgtgatgcatctttcagatccgccgcgtcatagtcatccagcgcataccaaatggctgaaagtgtgtggggatcaattgaaaactcatcttccgacagagcgccgtttttgttttttgcgtacgttaagttctgcaattcgcggatcgtatgttgacagctgtctgagcaatagatgtgtttgaaccgtttcagtttttttgtatactgaagtcttgagcccggaaactttttggccgcaaccatgcaaaagccctgcctgcgaaaatattggatgcttttcggctcagccgaatccgctttgatcagctctttttgatccgccaattcctgaagctcctcagctgtctgatcatcggtcattttgtttttgtaatactcccagaaaatataaagctctttttgatccggatcgacggcaagccggatgaccgcattgtatgactcttcaaaaccgaaatccatgccggtccgaaacagggggcgcctgatggaagcaatccgctccgttacttcgttgtgctccatgacctgaaactgcggaaacacgcggatgccattgacgccgaactgtcctttgcgggcgatccggtataaatcgggatcgtaatgccgtaaactgtccagctgcttaatatagcttttcggcaaaaacagattatcgcacgctgtggaatggtggtaatacgtatctcccttaacgacggtgcctttttcatacagcgtctgatcatccaatacgaaccgttttttttgatcatcacgaaaaaaatgccggtacgtccaattggaggtgccgacgggattggtggtgcatatcatatgaagcgaaaactcgggatggcgcagacgcccgatcagctccttaaagccttcatacttcacttcagagcattcttcaatccaaatcagggaaatatgatgaatggatttcaatttggccgggttgtccatccctttaaacataatccggcttccgtttgaaaatctcagctgcatcggtgaagacacggcctttacggcatgtcccagctcaagctccccgataatatcttcaaacaaggcaaaagtagaatctctgtgcgtatcgaaaacttcccgcacgacaagcgccgtccgcttttcacgaagcagcttcaggatgattttcagcgcggtatgatagctttttgacgagccgtagcctccgacgagaaattggtacgtttcattccaattgaacaaataatcttcaaagcgcgggttgaccgctttttcaatcatgaccgttcctctttccgcgtaatgacaatgtcaatcggcttttggctgtcttctgttttttccatcttctgctgtgccagctttaatttttcattttcgattttttgtttaaattgatcagggaaaaggtcaaagtacaaggacagcttttcaagagccttcatcttgtcggcaagctttattgcaatgccctcttttccgagttttgcttctgtgacgatggttccgtccagaaggtgcgaatctttaacgtcaacgtagctgatttcctgcataatcggcttatcattttcgtcaaagagcggccctgattttccgaaggcctgaacctctttttttccgaaggttacataatcggtaatgtcggcgaaagcgattttcacatagacttgaagaacgtccatcgcttcgacaaacactttattgaccatttcctttttcatgcggctgatttctttggcgactttttcgttttttaacagcctgcttcccgtcacatgcgcgctttccggtgaatagccggcttttatcgcagattgggtggcgttaaagcttttcacataataaagacaaaacagccgctggcgttcgtttaactcatcaccttcgcccgggttgttttttccgccgctttccgcgttcttatgaagcgcctcgtcccagcgcccttcttttttccatctgccgatcgttcttgcggatacgcctgatttgccggcaagggcgcgatttgtgatgcggcctttatgagactgatagattgtaaatgcctgttttctttttgcgtttttcatgctacggcatcaccgccacctccgacatgattgtctataataaaaagcggcttctaatcgggccgctttttgtgatcgtctgttcacttctaggtggcaaacgtatgacaacttatgaagcaggcgattgatttctttgttcctgctgtttttgtattttcagaagcgcccgtttgaccgtcgtctgtacggttgatttctttacattcagcaaggcggcgatccgttcatatgaaaagcattccgctttgtggagcagcagcatttctttttctctatccgttaaaacggctaatgcgtcccgcagtctgattctgtcttcttcagtcacatttgcggaaggttcaaacatcagcgcctgcgaataggtttctataattctcggatctttaatcagcattctctgataagcgtctctgcggtctatcgctcttcttatgccgggctgccggcctttttcaagccattcgatgacatattccacatctgtaatgatcgttctgatgatttttttatctttcagttcttctgaagtaagcaccgtttcatcggcttcctccagctgcttgtaccactttttcgtctctttcagcgtgcgtttatattcaaatagtaagtcttccatgcagatcctcctctttttcggaacaaaaaaaggacaccaaccaatgcgcagcatgtacgcgattgatcagtgtccgcaggctttccgtcttggacgtattctgtttttttcgattaattcaatttaaagccgatttcatattcgacccgggccagatccccttttcgcgtttcgacaagcgttttgccgtgctccggcgcttcggcgagccatgcttccttcttcagtccgtctacaataatcacccgaaccttgccttcttccagctggctttgtaatgttgtatgttcaatgtcagtcagttttttaggattcatgttttacgtcctccgtttttttcaggatgtttacttcatgtatgaggcttccgagctcatttatgaacgcttctttttcttcagaactttctccccggagcaggcggagagccgtttcggccgcctcaaaaagttccggagcctttgccatcaatgccgcgttgatctgctgagagtatgaacttaagttgaaaacggccgcgatgagccttccgtttgaataagggaacttctctttatccgcttcgctgtaagcggaataaatgtaaatgggtttttcttctccgctgtgtacggcccgccatggagcggggctgtgtttttcttgcaatggttatcctcactttccatcagcctcatgccatgcttcaatttgcttttctatccgtttcgccctgaacagcaggcaaaaaagccatttaatatatttatacacgtgcatcaagcctcgcttttgcgtcttgaaccattcgctcaagacgtttaatgaccggcgttaaatcagtgcctgttttgcagttcgggcaagggtgaaagacagcgccgaaacccgtttccgtcacaatgaccttcttcggcccgcacagcttacacattatctcgccccctctaatctgtggtttacgtcaaatgaattgccattaatgatgactaaataatcgctgcacatctcataaattcttgtgcccaaggcttcatcaacctgcaccagcccgtcacaggccagctcgctcgagataagaaccggcttatgatttaaataacggtaattcacgacggcgtacatttgttcaatctgccaatcggtcgcccggggttttccattcagcggtttgaacagatcgtcaataaaaagcacatccgcctgtttcatacggccaagctttgcatcaagcagatcaaaatcattttttaaatccgtaaagccctccacaaaaggaaaatacagcacgggtgtctgcatctgtctcatgacataattgctgagagcggtcaaaagatgggtttttcccgaccccggacgccctaaaagggcaatgctgtttttccggcagtttttaatcttgtcgaagttttcaacatattcaagggcgcactcatatgcgtcgacgactgcctgaggcttgccccgcgtgataaatcctttgaagtccagcttccgaaaggcgcctgtaatctcacttgcgctgaggatgcgctctgcttttcgttcggcggcgcagcggcacttaacccacacatccattcccagctggtttttgagataaccgccctgatctttacagagcggacagtcaaagcggctttcgtctgattcttccggtctgtccgccagtaatggacgttttccgtttttcaggtcggccagtatctgctcgatcgttcgttttgtcatgtatcgtattcctctctttttttgttgtgattgtccttcccgcaattcgtgcattcaagcggtcttccatatacttggcgcaatagctgaaagccttgatcgtttcagctgaagaggtgcgccgctgttcaaaagcggtaaagcattcgccgagccatttgattgcttcttgtgctgacgcaccgagggaaacaatacgggcgatggcctgataatcccggggcgacgggtatacgctccgcccctcctgtgcagaccttaatctgataaaatgggcggcaatgtcgttaatcgcttcttcagcagtatgattttttgttatatctatttctctccggacatttttgtcccggtgatccgccgatattgtccggtcagttgcttccgggcgggtcaatgtctttttcggcgtgaatcttttcgagtgctttacggagacgatgagtccgtaaggggcgcggacggttttgatatattcatgctgttccaaaacctcaagccaccgtctgacggttttttcgctgacggcaaatacatcggccatctctcttgcttttacgggcttatgaccaaggacgatcccccactttacaccgtcttttacgtgttcctttgtcgttgagctgatgaaccataaaaacagccaaatagcagaccctattttgtcataatgttctgaattcaataatccggaatagatgaaaaacgggtagcttttacgattcataagggacgtctccgtttgtcttcagacctatatagcgttcatactgcaatcggttatcaaatcggaataccggaagtccgcaagcggtaaaagatatcgaaccgcctgcttttcctaaacatctctggtcagccggattgctgctgaaacggatgattatcggcttcatctctcaccctcctgatcaatttcttatcgtattttgatacatttcgtatccctatgatgttgattatatacgatacctttcgtatcatcaagacctttttgatactttttttatcatctctttattttgatacattttgtatctataatcataagtaacttagggtgttgaaaaaagagaggtcattcggatgataggcggaagattaaagaatctcagaggaaagaaaacacaggaagaagtcgcaaatcatatcggtgtctcgcgcgccagatattctcattatgaaaacggccgatctgaacccgattacgacacgctgcaaaagcttgcggattatttcaaagtgtcgactgattatttgttaaccggaaaagaaccttcagatgaagacatgtttgccgatcccgacctgcagatcgcatatcgggacatgcaggacttttctccggaaagcaagcagcaggcaattgaattcattaattatttaaaagaaaaagagaaaaaccgcaggccgaaacataaataatccgctcttttcctttaaactgcttaacgttcagccgatataaaagctgaatgtttatttttaaaagaaaagggaattgattcaaagtccgatcagggcttttctttctcacttaaaaaagaacatacgttcgaaagggtgtattcaattgggcgattttttaacacatcttgaggaatacgtcaaaaacttatattgccgcatgggaatgaccgcccctctccatattgatatgcagatgattgccaaggagcttgacatttggattcattttgaagatacgcacagtatgatgctgaagcgggacggcatgtacagcatcgtcctgaatcaaaaaaagtcacccgaagagcaatggcaggattttgcgcacgaactgtgccatgtactgaagcataccggcaaccattttcatatgaacaagctgttcagggaactgcaggaatttcaggccaaccattttatgtaccacttctgtgtgccgacctttatgctgttaaacatggagcttccccaacggagaagccatgccgttattttaatcgcagccgctttccgggtgacggcatcatttgcggaaaaaaggctggagctgtttgaacggcgtaaagcaggtattcaatttcagaagcggctcgcttgtctgttatccgacaagcggccgaatgtgtattatgaaagcggacagacacacttgcatgccgctgaagaaaaaacgccgtattttattgaaaattagcgatactccgcggcttggaacgcagccggcagaatgtcatcattttcacatcgcaggaaaggtttttgcatcatgacgctgttctcaccgtgctgcccgccacgcacttcttgcgccgcatagcagctccagtaaatataagaacgggccccctgttcatttatcataaaaaccggccttcacggcttctacataccgaaaaaacagatcggttggcgtatatttttctccccggcagccaaaattgctgaacagcgcgtgtctctgcgccgtgctcacttccaattgcagccccattttcctttttgtccgattgacaatgttgcggggatttacacctgccagccgatcattcttctctgtcagctcggcatcaaaccccgcttcacgcagcagatcacaaatcagtcttgctttttccagatccgcgcccccgacgagtgtatttgcctttttcagatcatgatacccatgaaaagccaatccgtaatgatgggcggtcactttttctaaagccaggggttcgtcaaagcgtgtgcttgtcaaatggagagaacggttatcgcaccgcttcgttccttcaaataaataaattgagctttggtcagaaaatgcccgcaccagctcactgacacccggctcaatcctgccgccgtggggagcgaggacgatacatttacttccctctttttcttcataaataattctgtattccgattcagcagcagaaagggctgcgaaattatcatatctatctttcatgtgtaacatgctccttttccagtcagcaccagtttactctactcatctgggaattggaaacctttttatagtatgatttgatagaatacgtatcaggggggatatatcatggggttcatcaatggattgctgggcaatgcgtcgacaatatcgacggctgaagcaaaagcagaactggctcgtattctgctggcaggtgagaatgtcaacgccgcatttaagcttgtccgagatatcattgtctttacggataagcgtcttattcttgttgataaacagggactcacagggaagaaaacggagattcaatccattccgtacaagagcatttccagattcagcgtagaaaccgccggccgctttgaccttgattcagagctgaaaatttggatttcaggcgcggaacttcccgctgtctcaaagcagtttaaaaaagatgaaagcatttatgatattcaaaaggcccttgccgcagtttgtatgtaagaagaaacggaagcccggagagcttccgttttattgattacagtttttcttcaattttcgccttcgttttcgggccgtaaattccgtctgccgttaacccgctgacggattgaaaacgttttacggcatttgccgttttcggaccgtaaacgccgtccgccccatgattttttgctcctttatcaggataaaaataaagagcggataaagcgttttgcacttgttttacgtttgtccctttcgtcagcggtttcgtcactttgatcacacctgatggaagcggataggaagacacagcctgactttttgaagaagaacccgtctgagcgagcttgatcacttgtccgactgtaatgtgattcggatctgtgatatggttgatgctttgcagcgattttacgctgacaccgtgcgatgcggcgatttccgataaggtgtcgccttttttcacatggtattcagacgcggaagaagaaatagaggcttttttcgccggcatacttccgcttaatttcttttcaatcttcgccttcacttcatcccagcggccttcagacaaaatgcggtgcgggcagtactttccgttccagtcctgatgctttctgattctgtcaatcccccagccccgttctttcaaaagctgcgccgcgaacgcaatcgccagttcttctgcggctctgtaccgttcgccgcctgacttgctgtaacagatttctatagcaatcgactttcggtttccggtaccgttcgtgccgtctcccgaatgccaggcattccggtccaacggaattccctggatcacttctttgtcatcaaccgcaaaatgatagcttgttgattcgctgtttcccgtcatatagctgatttcgttagcggcggatgcgtcgtttgccgtgttatgaatggtaatatactccggcgtcatcggattcggacattttaacgcatatttatcagccgatacgagccgttttttcacttcaatccccactcttcatctctccttatgcctttttcatcaataggtggcattcgtaggacagataacttgagcatatagaccctgcattcggataaaaatggaatggatacgcatgcaaaaaataagacccttccaaagaagggtctttatgttatgtttggttgcgcgcggcaatatggaatgtgccgtccgcttgattttccaaatggctttcatggccgatcacctgtgtaaagctgaacccgacagcaacaagcagcaatcctgacaacagtttagatttcatatagacaatctcctctctggatttgtttttgggcgtgcaccattttttcataaaacgtgagcgctttttcaggctgtccgtgtttcatgtaaaatttggcagcgtcatgcgccaattcttccacatacggatacagcatgtgttcttccagaaaatcaaacgtgtgcctgacggatgcgttatccatttccttgccgtataacgcatgtaaaaattggaacagattcacaaacaattcatcattgtattcgcgggcgatactgagcccgaggcggtattgcttctctgcttcggctgtagtgttctgtttataaagaacctgtgttaatgagtaaatagaatgcggaagattatcgaacttttctgacctgcaaatggaaacggatgtctcaaaatattcggctgctttagagaggtctcccattttttcgtaacagtttccgagattatataaggctgaactgataagacggggattgccttcttgttttgcaagatctaaagcaagttctaagtggggcaatgctctttctggatactgcatgtcatcataattccctgcaataacgaattcacattggattctgcggacgttgtacgtctcatacgattggtacgtttcaagggcttgaacggcataactcatggagacgtaggtttgtttcaggttgtaaaatatctcggccattttaaaagcaaactcagctttctcgatgtcatcagaaacgagtgcaaggtttttttcagcccgtttgtaatacatcatggcgtttaggaacattttctgtttaaattcgtacattcctcgaaaaaaattaaagtagtaatcaagcagtcctgtcagtttatactggttgccttcaatgtcttccaataattctgaaaactcaggctgagaagggtcctcttttaagggcttgatgtaatccagcatgacacggtgtctgaattccattaatgaataatacagcagcagatcctgatcttcttccatatcctcgatctctctctctacttcacgtttgacgcgctccgcctcaaggacgtgaaactgccggatatgggtataccattcattaattttgagcccgacaaaagaggacggaatagtctgcttcatcctcaataaatccccccttttggaatgaccgagatatgtcatattttatcatatttgctagaaaaagaagaacgcaaaaagaccgcaattgtcgaatttcggatatccgcaacgatttatctccgtcacaagcttattgcttgtttcttccgtgccgttgatatagcatatccttgcagctttttattctgtattaaatgggggttttcacatgacagcacaaaatcaattggtcagccactttctgtcacatcgaaacgtgacgattgagctggcggaaaaaatcagccgcgaacattacgattacaagccggcagagacatcaatgtccgctcaggaacttgtaaaacacatcgtttattcttttcttatgtttgcaaacgtcattaacgacggaaacggatcagctatccagaacaaaccgaaagaagaagcggaaacagacctcgtcaaactggctgaagcatgtactgaaaaaacgacagacatcctgtcacagctgactgaagagcagctgaaccgcgaaattgacctgactgcctctttcggcagaaaaataaacggcgcggctctccttcagcttgccatggagcatgaaattcatcataaaggcaatcttttcgtgtatgtcagagaaatgggccacacggaacttccgttttatcagcaaaaatcataatccggccatccgccggtctgcgacataacagcaggctggcggattttttgttctgtataaaattttccgaaaatttaattgattaccgcctcttaatcatatataatctgataaaaatagtaggattattcaggaggcacacagatgactgtaagcattgtgtttatgggtttctttgtcggaacgcttgtcggattgacgggtgtgggaggagcagcgcttttgactcctttactgatcgttttggggatcaacccctcaatcgccgtcggcactgaccttttatataactccatcaccaaactgttcggtgtcgtttctcattggaagcagcgcaccgttcaatttaaacttgtcggctacttggcgctcggaagcattcccagcgcaacagccgccatcggtgttcttcacttgtttcccgcttttcaccagcatcaggagcagattatcaaacaggcgctcggctacgtgctgacccttgtagccatttccattatcgcccgcctttttttcgataaaaaactgcggccgaaccgctggcagcaaaaaacgcttgaagaaaagcggacactcatgatattgatcggcgtcattttcggtttcatcgtcggcctgacatctattggatccggctcattatttgcgatcgccatgctatacctgttcagaatgaaaacggcagaagtggtgggaacggatatcgcacatgcctttctgctcgtaactgttgccggtctgttaaacgcaagcttcggaagcgtcgattacctgcttgtattgaatctgttgatcggctctgtgccgggtgtgcttctcggcagcttcttttcgccgaaattctcaccgcgcccgctgcagtttgtgatggcggcgattattttaatcagcggaataaaattaatataaaaaaggcggtctgttgtcagatcgccttttcccttataacgtcacaccggacttaaagattgcaagctcccgaaaatcgtttttttcgttattgacgaattctccgcttgcaactttaataatgtattgaataaaatctcttacaatgtgatcttctgttgtttggtcttccgccaatctgcccgcgttgtaatcaatccaatgaggctttgattgaaataaatcggtatttgttgatactttcacagtcgggacaaatgtgccgaacggcgtgcctcttccggttgtaaacaaaacgatgtgacagcccgccgcggcgagcgctgaagaagctattaaatcattgccgggcgcactgagcagtgtcaatccctttgttttcagtgtttcaccgtatgtcagcacatcagaaaccggtgcaagaccggctttttgggtgcagccgagcgacttgtcttcgagcgttgaaatgccgccttccttattccctggtgacgggttttcataaatcggctgctcgtgcttcataaaatattgcttgaaatcattgatcaatcggactgttttatgaaacacttcttcactcgccgcacgctgcatgagaatcgtctcagcgccgaacatctcaggcacctccgttaagaccgtgctccctccctgtgcaatcaagtaatctgaaaatctccctaataaagggtttgcggtgatgccggaaaaaccgtccgacccgccgcatttcaatccgatgctcaattctgacagcggaatgtcctcacgtttatctccctttgccgcaaggtgtatctctttaagaagcgcagtacccgcttcaatttcatctgtgacagcttgtgattcgagaaatttcacccgatctccgttcacttcagaaagggtttccctaatcgccgccagctcattattttcacagccgagccctaaaaccagcacaccgcccgcatttggatgacggatggcgttcatcagcatttgtttcgtattctcatgatcatcgccaagctgggagcagccgtattggtgctttaaaaccagcacattgtcaaagggcgcaatgtctttcgcctcttttacgaaacgctgcaggattttctcagcgacgccgtttacgcagccgactgtaggcacgatccacagttcattccggacgccggatgtaccgttttctcttctgtagcctttaaatgtccggttctcatttgtaaaaggattgtcctcgaagcgcggtgaatacatgtattcttgcacatcggataaattcgtttgcagattatgggtatgaatatgctcgccggccgaaatccgccttgtcgcacgcccgattgaaaaaccgtatttaatgatgctgccgttttcttcaatggtttgcagcgcgattttatgcccccgctttacagggtccttcacttcaatcgtcagtccgtctgtatgcagccgctcccctttgttaaaatggcgcatggcgagaagcacgttatcgtttttatggatttttatgacctctttcatttcacttcccccttttttccgcagcattcatgtaacgcatgcttcataccccgcttatgaatgacagacagaaaaaaagccgttcgttcattcagccccggaagatgattcagattcttcccccacaatcgctcttctcctaatatggcagatgccgcttgaaacatatcatctttgcaacgggaccgcgccatttgaaaacggttaagaacctcctcgccgtctgccggtttgttcggtccgttccagtatgaatagatcatggcgctgaacgaaaataccagcttctcaggtagccggccctcctgttcgatataagccttcagcgtcggcaggtttcttgttttgaatttcgcggcggcgttaagggtaatgctttgcagataatggtggatataagggtttttaaaccgctgtaacacatctgccgcgtattgggtgacaccctctatttgcagcacagggaggatttcttcattgatcagctcttcaatgaatctgcccgtcacctcgtgctcagccgcttcccggacggtttgcagtccgtatagtaaagccactggcgccaatgccgtgtgagcgccgtttaagattctcaccttttttgtcctgtaagacgtaaggtcagacgtgatcagtgcgttcagcccggcctcagcaaaaggaagctcattctgaagctgttccggcccttctatcacccacaaataataatgctcaccaaccacaagcagacggtcttcgtatccgagaaaatcggtaagttcttccgcggtatcaacaggaaatccgggaacaatccgatccacgagggtattgcagaagatgttcgcgtcatgaatccattgagtaaaaccaggttccagctcccacagcccggcatattgaagcacggccgccttcagtttccgtccgttttcttcgaccagttcacatggaagcacaatgcaccctttctcggcgtcacccgcaaatgccttatagcggaaataaaggaacgccgctaatttcccggggaatgttttttgaggtctatcctcaagccggtcgcctttctcaaacgtgattcccgcttccgtcgtattagaaatgataaaacgaagatcctcttgtgctgccagccgtttaaaggaatcatagtcagaaaaaagatcaatgccgcggctgatggatttgacgatcgtgtgttcttcagccggttttccgtcctttatcccctgcaaaaaaagcgtaaataaaccgtcctgctcgtttaaacgttttattttctcagagcctctcggctgtacggcgacaacgcttccgttaaaatccgtcaattgattcaattgatcgatctgccagtcagcgaaagcccgcaaaaagttgccttcaccgaactgaaggactttttcaggatattgaatgtattcgccgcacatctttttattcagctgctgcaagctgtccgcctccttctgcatttatgcacacgttaacattttaccgtacgaaaaaacggatattcagacgggccgttatgtgagttttttaatggaatctcttatcatcacctcggtgttttcgtatattttttccgccgccgtatccgggtcggcgattagcgccaaaatcttctctgcgccaagtatgctgatgttttcaaccgggcgttttactgtcgaaagcctcggcgtcatgtattgggaaatgccgatgtcatcaaacccgataacggatatatcttccggaacgttcaggcctttggcgaaaatggcgttcatcgccccgatcgccatatcatcgtttgaacaaaaaacagccgtaggaggtgattgaagcgccaagagtttttccatcgcctgactgccgctttccatatcatagcggccttttacactgtattcatgcttaatcgggatagaatgatcaattaaagatgtcaaatagccttctttccgctgagaagttgacctgaatccttcctttccctcaatgatcgcgatatctctgtgtccgtttgcgatcaggcagtcgaccgcctgtctggagccttctttatcgtttgacaggatattcgtgatgctccggtcatcaatgtcccggttcagcacgacaagcgggatgtttttctcgcggatatgataaataaatgaattatcactgtcgctttggctcattaaaatgattccgtcatatctcatgggcgtaatggtttcaaagcttttcaggtcgtcaatcgcgcggacgaacaaattgtattcctcactgattgtgcggtttacacctttgatggtatcggaaaaaaagctgtgtgaggttccgtttgtgatgcttgtaaaaaacagcccgatcgtatgggacttttgcatggcaaggctttttgcatttacattcggtgtgtaattcagctgtgaagcgagctctaatattttctgttttgtatgctctttaatgtaggggctgccgttaagtgcccgggatacggttgtgtgggatacgttggcgagttttgcgatatcttttatggttaccatcgtttttcctttctttctgtatgctggcatttatttctattgtaccattaacggacagtccataaaatcacaaaagttaaggttttgcatgatgtaagtcctgaacgagctcggcatgctgccggtccgtcagtttatacattaaaccgataatcagcatggcgcacgctaaagcgaaagccgggtacagcagcagaagccctttaatcccgatcagcgtgccttttgtctgagatgcattcgggatatagccgataacgctcagcccgatgcctgaaagaaaacctgataaagattgggcgagttttctggagaagttgaaaagcgaatatgtcgtcgcctccttccgttcacccgtcttccattccccgtaatcaataatgtccgacacaagcgcccacgtaatgccgtttggtatgctgatcccgataaaagcaatgctcgctaacgccgtaaagatatatacatttgacggcagacagaaattcagcgcatcagccgcggcgctgacggcaaaaccgatcatcaccgtttgcttttttccgaaacgtttgacgagtttcggcataaacaaaacacctaaaaatgaagaaccgatgataataaaactcatgtaggacatcagctccgcattgttgagattgtactgggcgaagtaaacaagcatagcggatttaatgttatatgccgatattgagaaaatcgtcatgaaaacgacggtcagaagcggtttgttgccgataaagcatttgaaaaccgacatgacggacagcttttctttcggcgcttcacggacgataattctttctttgcagtttcggtagcagatcataaatcccgcgattccgattacggccatcattcccatgactgccgggtagccgatgtgaacgttatcaaaatgaacaagaatcgggatgacgatgacacttgtaatgagcagcgcgccgagggagcctatctggcggaatgcggaaagcgccgttctgtcctccgcatcctgtgtaatggccgcgccgagagagccgtacggaatattgacgaaagaataagcgaccccccacagcatgtaagaagcataggcgtacacaagcttccaggtgacgctcacgtccggtgacacaaaaatcaatacggtcatgaccgcaagaataatacttccgaataataagtacggcctgaatttcccccggggtccgatcttttttctgtagtcaatggccgagccgacaatcggatcagtcaaagccgcaaacagcttgctgaccaaaaaaatactgccggcgaacgctgccggaatgcctgcgacatctgtgaaaaacttcagcaaatagatctgcccgagatcaaacataaatccgttcccaaaatctccaaaaccataggatactttttctttcagactcagcttatgctccttcacttttgcggcaggtgctgtcacgacaggcacattactcataggccacctctttcattccattttttaaaagcggaaatattcctcagcattccggtaacaaatcccctcgacaatctttcctaaaagctccatatcgtaaggcgcttcgccttgttccgcccagccgccgatcagcgtgcagacaagccgcctgaagtattcatggcggggataggacaggaaacttcttgaatccgtcagcatcccgataaaacggctgaacaggcctgtgtttgataacgctttcatttgctggagcattccatctttcgtgtcattgaaccaccaggctgtgccgaattgaattttccccggtgttttcccatcctgaaagctgttgatcatgctggcgataatatagttgtcattcggattcaaagaatacaaaatcgttttaggcaattgccgctttttttcggcggaatctaacagccgggcaagcggttttgcgatacgttcatcattaattgagtcatatcccgtatcaggaccgaggctgctgaacttatttgtattggtatttcttaacgcgttaatatggaactgcatcgcccagtccagttcggcgtaaagaccgcaaagatattgcagtgtccgtgttctgaatttcttttcatcttcaaaagacacatgctctccgcttaatccggctgcaaaaatccgggccgcttcctcttcggtcgtctcggcataaaccatttgatctaacgcatgatccgacactcttcccccggcattgtgaaaaaagcggacgcgggattctaacgcatctaaatacgattggtaggtggtgacagccattccggaagcgctctccagcgaacggacccaatcggcaaaacccgggctgctgatgtccagtcctttgtcaggccgaaatccgggcagcacttgaaccggaaaatcactttctttcaacagttcgtggtatgtcagcgcatcggcaggatcgtcggttgtgcaaatgactttgacatttgatttcagaatgagatcccttgcgccaaacccgtctccctgcaggagctcattcgtttttttccaaattgccgcggccgttttttcattcaatacgtcataaatgccgaaccagcgctgcagctctaaatgcgtccagctgtacagcggattgcctatcgccatcggcaccgtttttgcccaggcgaaaaacttctcttcatctgaagcgtttccggtaatgcagcgctcttcaatgccgttggccctcatgatccgccacttgtagtggtcaccgtaaagccatgcctccgtaatcgttgcgaaggttttattttcatagatttcctttgggcttaagtgacagtgataatcaatgatcggcatgttttcggcgtattccctgtacagctttacggccgttttactatccagtaaaaaatcatcacccataaaagctttcacattttcatcctccctcttaaaaatgttaacgttaacaaaatgattcttttttattttagcttcctctttctcacatatcaatcatttttattttatttttcagaaaattgtatccgttaacattttcatacaaaaaaaaagacactgccgagaaagtccggcaatgtcttctgtgtgatcttaaggattagtaagcgaggctgaataatcctttgatatgtgttaaataacgtacgttacttgcttctttcattaaagatgccggaagacctttcagcggagtagagttcgctccgatgatggcaaccgcgtctttacgtccgaggcttgcaagcgtaccagagtttacaggcttgaatgtttcaagcgtttttccttctaagtaagcgaacaggttgtaacccacaagttcacccatctgccaagcgatttgcgctgtcggcgggtacggacggccgtccggcgcaaagtatacagcgctgtctccgacaacgaatacatcttcgtgagaagtagattgtaagaaatcgttaaccgtcgcacgtccgcggttcacttcaaggccggattcgccgactaacgggttgccttgtacgccgcctgtccatacaaatgtgttggcaacgacttttgaaccgtctttcagatcaataacgtttccttcaacatttgtaacaggaagacctgttaagaactcaacgccgcgtttttcaagactttttgtcgcgcgttcgataaggtcatcaggaagaacaggaagaattttcggacctgcttctactaatttcagtttgattgctttcggatctacgccgtattttttcgtaaggttcggcatgatgtcagcaagctcaccgacaagctcgacgcctgttaagccgccgccgccgataaggatcgttgcatcagcttcgtttttcgttttagcgtattcacgcacacggtcttccacgtgtttgtatactttgttggcatcagcagcagatttcagcaccatgctgttttcttcgagtccaggaatgccgaaataagccgtaacagaaccaagtccgacaacaagcgcatcataagtcagcttagaaccgtcagaaagggcaacttctttcttatcaactgagaaagaattgacttctgcgattttaatgtcgacgtcttttcctttcagaagtttttcaagcggcatagcaacagcctgttcagacacgttgcccgctgcaaggcggtgcagttccgtaatgatttggtgagtcgggtatttgttcacaacggttacgcgtgcttcatctttactgtaatgtttgcgaacggttaaagcagaaagaactccgccgtaaccagcgcctaaaatgacaatatgttttgacatcgtatatcctccgtcctttatatcaatttgaatctgagattatttttgtttttcgttcatgatttcaagatagctgttagcaaaacggaacagcttttgagcttgaggatctttcagcatgcgcagcaggccgaaaagtccgatcgtttcattgcttgcatccgcgcggtcttttgcttcgatcgcagtagccgccacttctttcgctgtttctttcaccggctcaagaatttctgtaagcgcacccactgtatcgctcttcaatacttcgtctgtcgctacagactgtgcaaaatcataagacttcgttaaaatatttactaactcagtcagttttggaagctgatccactaaaacagtcagtgattcttgaacttcaggttttagcagctgatcaataagatcgcgttggccttggctgacagatgcatttgtttgatcgattgtttctggcatatccgattctcctttactataagcagtatgctgatttttttggaaagggtagcctttcccccttcatgcagaaaagcatgaaaaagcaagattgtgaattcatgcacaatcatttacaaaaataaatgtttactacccagtttttcactttgccatatccagtattatttttatatcaacaaaaacaattgaataagtcaaaatttctttttcctctctgaaaatagcaaacataaaaaaccccaatttgatttactcttatataataacactttttgaacaaaatttgaacgtgaattgtttcgtttatgaaattatttatatggcgggggtgtaataacgtttcttttaggctatttttttacagaccatccgctttccccctgtcatttttcccacaattttaatagcgggcccgtttttcccgtaaaggggtcgcattccgggagcgggacacggctgattacttctggagttctatcatttttctccgtttttgtatcgtactgccggccgcccggataagccccgatcacggtaaaatcagaactgcccgacagttttttatgtccggtgccggccggaatgaccgctgagtctcccatttgaagaacggcgtccgctccttgttccccgccgaacctcaaaaccgcgtttccttttaccgcgacaagaacttcgtgcgtggtgctatgaaaatggtgatacggaaatactccgcccgtccagctgttcgaccaatcgtgccggctgaggacggactctgctttctgcaccgtttcttcattaaataccgctttataaataacaagcggaagattcgggttattcggaatgcggccgtcatcttcaaaataaagcacttgaatatcctctttctgcattgttttcacctccgtatatgtctgtttcccattcatcatttgttaaaacgctattttctcatattccattgcgaagcctgccggtgaatagtatagtataaaaaaatatgtgtcaaatgagggatttaatgaaagccatcgtgatcggaatattggcatctctgttttttgcagtcacatttattttaaacagggcgatggagctttccggcggaagctggatgtggagctcttccctgcgttttctttttatggttccgtttttatttttgatcgtttatgcgaaaggaaaatgggcgccgctctggcatgaaatccggaaaaaaccgtttttttggctgaagtggagttttaccgggttcgtgcttttttatgccccgattacgtttgcggcggcatatgggccgggctggctgatcgccggcacgtggcagattacaattgtcgcgggtgtgcttctgtcgccgtttttctacgaaacaaaaaattcaccggcgggcccggtttccgtcagacaaaagatcccgctgatttcgctggttacttccgtcatcatcctgatcggagccggtctgattcagcttcagcatgcgggttctctgtccggccgcacggtactattcagcgtggtgccggtcgtcattgccgcttttgcctatccgctcggcaaccgcaaaatgctggaacaatacggcggaaaactcgatacgtttcagcgggtgctcggcatgacgctcgcaagccttccgttttggcttttgatcgccgctttcggctggcatagagacgggcttccgtcaatgggacagtcattccaatcctttatcgtcgcactcagctctggcgttatcgcaacagtattatttttccgcgccaccgatatggtgaggaatgagccgcagaagctcgctgctgttgaagcgacgcagtccggagaggttctttttgcactgatcggcgaaatcgtctttttatccgcggcgtttccgtcacttctttcatttgccggactgttcattattattgcgggaatggtcatgcatacattcgcttcccggcagacagaccagaaaacggctgagcaaacggcagccaatctcaccggttcctgatttttttacgaaaggtgtcctcctgtatgaaagaagaaattccggcaatatcttttctgtcagccggcaaacgctttgaacaaaacaatacgtcctttgatgtcctcagccgtgtaaccggacatattcaaaaaggttctatcacggcgttgataggcccttccggcgcaggaaaaagcacattgctgtcactgtgcaatctgatgaatacacctgatgaaggggaagtgcttgtattcggaaaagaaataagacactgggacatcagagagctcagaaaaaccgcgggccttgcatttcaatcagctcccgtcctcgagggaacggtgcgggacaaccttctgctcgcagaaaaactccacgggacacagcactatacgcctgaagagctcgcagattttacagaccttccgcgcgggcttctggatcgaaatgcaaaagaattatccggagggcagcggcagaagctctcattagcgcgaactctcgccggactgccgtccatcctgctgctggatgaaatcacctcggcgctggacccgtcatccgttctcaccattgagaaactgattacgaaactccatcggcaaaaacagcagacggtcctgtggatcacccataaccttgaacaagcggaacgattatccgatacggtatggtttatggctgagggtcggcttttagagaccgcggaaacgaaaacgttctttaaggaaccgaaacacgaaaaggcccgggcgcttttacaagggagcgggtgctgatatgaatgatctttctctattattgacaagtatatttgtcattattgctttattcctgtctaaatcttttaaagccggcgtcgaaaaggatatgatcgtcgcaaccgtcagggccgtcattcagcttctcatcatcggctatgtgctgtcgctgatttttcgcggtgatcacccgatatttatcatattaatggtgcttctcatgctcacggccgcttcgcacaatgtctccaaacggaataaaatgcggatcggctcattttggcgcgtttttctgacactggcgatcgcggaaaccgtgacgcagggacttttactgacccttcacatcattccgttcacttcaagatatgtcattccgataagcggcatggtcatcggaaactccatggtgctctcaagcctgtttttaagcaggctcagttcggaagcagacctgcggaaagaagaaatccagctgattctctctctcggaggaacgcctaagcaggccgtccggcagatattgacgtccagtatgaagctcagtatgatcccgacgcttgaaagccagaaaacattgggtctcgttcagcttcccggcatgatgacggggcagattttagcgggggctgatccgatacaggcggtgcgctttcagctgctgatcgtttttacaacgatggcctccgctcttcttacatgtatcatactcagcgccttgacatatccttcccttttcacggaacactggcaattaaaaaaattcagcagggaagcgtaggcttttttccctgctgaatgatggtttatgacaaggtcagagattcatagtaacgggataattcaataatcatcgctcccatccgctcaatgtccggagcaaggaccctctttaccccttcatcccggatcgcttcagccgtcactttgccgactgcggcggcaagcacttgtttttcgaatgcctgctgcaattcttttgtgatccctttttcttttgcataatcaaagagagaacgcacttgaatggctgtcgtaaaacatacggcatcgacctctccgtttaacagctctcccagcagtttatcgaccgtctccctttcaggcggaatatgctgatacggcagaacagggaatacctccgctccgtttttctcaaggaactccgttaagaccggcgctttttcgccatgaagctgtatcatgacttttttatctttaaagtcaaatcgttccaaggagcggatcagccctcttgttgtaccgtcttcatctgaggcatgcggcgtgatgccgagtttttttaaggccgcatatgttttatagcctctgcagccgattttcgcttcatgaacggccgctaaaaattcttctttcagaccgattttttccgataccgacaataacgtttccgtaccgatgcctgtggtgaatatcacccagtcggctttttgcccggcaaatgttcttacgtcgggttccatttgatcctccgccaggtatacggttccttggagggaacggacgaccgccgttccgccctgcttttctattaatcttgtgatctcttctgttttccgcgaaccgccgatggcaatccgtttcccgttcaatccttttcccatcgctgttttcttcttcccttcagatgccgggcgccctatggcaggccgtcatttatttctattattgttacgcaatcagccgggaaaatcaagctatgctcccgttgaatcccccgtgcagttgctgtatcattaaccgggcagaacgatttgattcgcggagggattttcaatcatggaaacaaaaaaagagttcgagacaaaaggatacgatacttcggtcatttatgagttcaatgaatatcctgatgttcacagcggccgatgtgacaattgcgactacacgctgtttaaaagctcagtgaagggcggaaaatttttgagggaatgccggagatgcggcatgaagaaaaacatataacaaaacaggcagccgtcttccggtgcgctgcctgtttctcaatcaattttcgacggccgcctttttcaaaaattcttcaatggcacaaacagcctgtttggggccgccggtttcttctattttctgctgcatgcttttcacgcggctgaggatgtttttatcgctgtatacgttctgaacgtctttttgcaaacgggccacagtgacttctttcggcggcagatgcacgccaagccccaattcatccacacgctttgcggtgacctcttgttcgtgcatttgcggaacgacaacgagcgggacacccgcattcatcgcttccattgtactgttcatcccgccgtgagatacgaacagctttgctttctccagcacatcaagctgaggaacgtgctggcggatgataaagtgatcggggacatccgaaaaactttccggatcaattgttgtgccgactgacataataacccgccagtccgagtcccgaaacgcgtcaatacacatctggtaaaattcaggccaggcgttaaacgccgttcccagtgagatgagcataagcggacggtcatcggctgcatcaatttccagacttcccgtatttgtgcgttctccaagagacggacccacaaaacagaatcgttcatcaaaggtttcctgtttcggctgaaaggcccttggcataaagacaatattcagtttttcaggcataaaaaattcttccattgtcatccgtttcaattgttcattttcaatctgctcctggtattcttctatcgcctgtttggccgcttccagtgtttcttcgtctcttcctaattgaaaatactcattcattgcatagctcgggcagaactttacggccgggatgccgctattatccgcaaacaattttccggcaagagctaaaaaatcaaacaggacgatgtcaggaaggtcgtctttgtacagctcttccagctgcggaagcacttcaaccgcttcttccagaaacatcacaaacgcatcatttttatttacccgttcttttatcgtctccgggtccgcctttatgcttgtgcggtataaaacgggaatggcgcccgttttggcaacggaagcttcgaattcctcagtcgtagcgaatgtcactttatacccgcgattgacaagttcctcggctacaggcagcgtgggattgacatgaccgtgagcggccacattaataatggcgatgtgtgtttttctcatcatttttcttctccctcattttcgtttatctccgcttctaaagactccagcccgtacatgacactgtttcggatcggctcaatctggaccggctcaaggtgtgaaaaggcttttacaattcctttcagcgccacttccgcttcaagtctggcaagcggggcgcctaagcagaagtgtacgccgaatccgaaggaaaggtgcggattcgattggcgatgaatatcaaatacgcccgccttctcaaatttgttttcatcacggttggcagatgcaacgtagcagagaacgatctccccgcttttcaagcggcgtccgcgcagttcagtgtcgtgccggaccgtccttctgacaaacggagcgggagcgcgaaaacgcagcgtctcttccaccgtttgcgcgatgagagaagggtcctgtctcagctcttcataaaggccgggcgtctctaatatgctgtaaaacgcatttgaaatgagattagtcgttgtttcatttcccgccactaaaagcaggttgcaaaacgggatcagatcttctgccgtgagcttctctccctcttcttcctcttttatcaaaatagaaataatgtcttggccgggctgttttcgtttactttctattatttccgcaaaaaacgccgccagctccgcctcacattggtcacgttcctgctgatttttctccgccgcttcaggactcgcatctttcggcatgctgacgagaatgtccgaccattttttaaactgatccatacgttcggacggaacgcctaataattctgaaatcaccatgaccggcaaagggtaagagagatctttaacgatatcaatccgccctttgttctttgcctgtttcaggagatgatcggtaatgtctttaattctcggctcccattccttcaagacgcggggagtgaaagcgcgattgacggcggatctgatttgggtatgcttcggcgggtccatattcagcatggactttgcaatcgagcttttcacatcagtcatgaggcttgagaacgtctctttatcactgatgacttttttgacatcatcgtataaaaacacactccaaaccttcgtttcttcatcaaagtgtatagggctttcccgtctcattttttcataccaaggaaaagggttgtatacgtccaggccgttttttcctttcatcagggttctttggatggcttgtctcgtgctcctcagcttactcatgtttcatcactcctgattgtttcatatttgaatagttgacgtaccttgaattttatcctagcacatattttcaatttttttctattcataaccttaactattaacataacacaacaaaagtcatgaatccggaggtgaaatttctcccaagaaaacagcataagcacgcaaaaaacccgagccttcggccaggctcgggagatatgttcactcattcgtctgcggtttctggtgctgcttttggtcttcaggaggctgcgtatttctttccatatcgtccgtatcagcgcccatgcctttcaggaaagaaaacagcagagtgacggccttgttgatttccgggtcttttaaagcgcggacgatatcaaaatacccggtcttcctgccgctgtctttttcctcgacggcctttgtgacccccgcattgattttaacgataaacggctcaagctgttttacatcgagcatgccgagaacgccgcttaacagcaggagatttttcagcatattggccgtttccggattattcgccttcttcacgaggatatccatcactttgtctccctggccgaagagcccgcgcagaagcgccaaaacgccgcgctcgttcatgtgctgaagaatgtgcagagattccaaaatcgcgtctttatttcgtaaaagagccgtctcgatctcttctaagtccttttttcgtttgtcttcttctgtgacggtctgttttcggatgccgctgattgctttagccattttgctgcttccccctttttacggcgtctcccggaaatacataatctttacgcgcccatttccgatcaacccggacaccgatctgcggctgcgggtttccgtaacggaaattgattttcggaagcggattaacgccttcttttttcaaaatctccatcttcgctgatgtttctttataagccggtgtatcggtatccttatccgcatagctgcttgtcaaaaggttaatggcggcgtcttttgaatcgttcatcggaagatagacttgtttaccttttaccctgtctgtgatgacgcatttgactttcacatttccgtacggtgaagtcagacggacaagcgttccgtcttccagccctctttcttcggcgagttcgggcgagacctcaaggaacacactcggtgttttttcggatattccttttgatcggtaagtcagattcccttcgtgaaaatgctcgagcagcctcccgttattcacatggatatcatattcttcatcaaattctttcggctcggtccactgaacgggatatagaatcgctttgccgtctgaaaacgggaacttgtccgtaaataaaagcggtgaatcggttccgtccgctgcaaccggccattgcagtgaattgtagccttcgagacgttcgtaagtgacgcctgcatagagcggcgaaagcattgccgcttcttccataatgtctgccggatgttcatagtgccaatcagcgcccagacggttggcgatatccgtaatgatctgccaatcaggctttgaatcgcccagcggttcaaacacttcgtaaaggcgctgcaccctccgttccgtattcgtaaacgtcccttctttttcaaggctcgggcttgccggaagcacgacatcggcgaactcggccgtacgcgaaagaaagatatcctgcacaacgaagaaatcaagcttttcaaatgcggcatgaacatggttaatattggagtcgacaagccccatttcttctccttttaagtacatggacttcagttttcctgagtggatgccttcgatcatttcatgatttgtcattccgatttctttcggcaagtctgttccccagccctgctcatactttttgcgggctttttcatccgttactttttcatagccggggaagctgtcaggcatactgccgaaatcactggctccctgcacgttattatggccccgaagcggatatgagcctgcgccgggcttgccgtaatttccggtcacaagaagcatgttggaaatggccgtgctcgtatcacttcctccgatatgctgggtgacacccatcgcccacagtgcgcacacgctgccggcttcatgaatcatccgggccactttgattagggtatccttgtccacaccggtatgtttttccgcatattccattgtataaggttcaaggcttttcacgaattcatctaatccgttcactctctccttcagaaatgcagtatccgccaaatcgtgatccagcagatatttcgatacggcattcagccagacaatatctgatccggcacgcggctggaaaaacacatcggagcgctcggccatttcatgttttcgcaagtcagcgacgacgagcttctgtccgtgcagtttatgagaacgtttaatgcgtgtggacaggacggggtgagactcagacgtatttgagccgataatcagcacgagctcagctttttctatatctgtaatcgaccctgaatcaccgccgtatccgaccgttctgaacaatccggccgtggcgggagactggcagtagcgtgagcagttgtcgacattatttgtgccgatgacggctcttgcaagcttctgcatcacgtatgattcttcattcgtgcatttggaagatgtgataaaggcaagtgcgtccgggccgaaatgttcttttatatcggtaaatttatcagcgatcagctgcagcgcttcatcccattccgcctcccgaaacgagtctccttcccggataagcggtttggtaaggcgcttttcactattgacgaaatcccagccgaatttccctttcacacacgtcgaaatgccatttgcgggcgcctcggcctgaggttctacctttaaaatgtctcttcctttcgtccatatatcaaaactgcagccgacaccgcagtaagtgcatacggttttcgttttcttgattctttcatcccgcatggccgattccatgtccgatatggccaaaatcgatccgtatccggtttcgacgccttttgtgatgtcaatcatcggacgaagcgtctcttggttaatgcctgttaaataccccgcttcgccttccatgcctttttccatcatggcattacacggacataccgtcgaacaatgtccgcaggaaacacatgatgattcattgatcggcacatcctgatcccaaatgacccgcgggcgtttccgctcccaatcaatgcttaaggtttcggttacctgtacgtcctgacaggcttcgacgcagcgtccgcacaaaatgcactggtcgggatcatatcggtaaaacggatttgattcatctttaggatacggtttttgatcgaacggaatgctttgatgattgattttcatttcctttacggtattatgtacttcgcagctcccattgttgtaatcacagaccgtgcagtacaattcatggttgtgcaaaatgttgtccatgccgataatctgcgcttttttcacatcggacgaaagcgtatcgatgacatctccgtcctttatttgcgcggaacacgaacgcaccagttccccgttaacattgacgatacaggtatcgcacgtttcaatcggcccgagactcggatgataacacacgtgcggcacgtcaattgaactattgttcaaaagctgcaaaacggtttgaccgtcccgagcttccatttcaaccccattgattgtaaccttctttgtatcagccattttcttttcccctttctgtacccctctatacatcctctatgattcccagccggcctttcactaaaacatctcgtttatctcaggaaacatgcgggtatgagcggtaaaaaggaggcgttcacatatgttgaagaaaaaaacactcgtcaccggattatcggcggtgatgctcacgggatgcgcattcggagcagaagcattttcggatacacagcccgtccatgccgcagccgcttcaaaaacagaaaaccaacgtgcacaagaactggtgaacagcctttatcaatcggcgtttaaaggggaaatgccgcaaaatgtgaaaggcctgaaagtcaaccaaagcacaagacaggacgtttacgataaaatcggcgagccggaacaaaaagcagacagccgcaatctatttgatttatacagctggaacatgggaaaccccggttatggattttcctatcataaaaacggaaaaatctcggaaatacgctatttcggaacaggggtcgagcggcgcttaaacctcgggagcgtcacacctgacgtcttaagcaaacaaatcggcagcgctgacaaaatcctggcagtgccaaaaacgggcgaaacagattacgtctaccatacggggcagtatgagctccgcttcgtcatcggcagtgaccaaaaagcagaccacgtcaacctaaaagccagataacgcaaaaaaagcggcctcccgggccgttttttcatagacagcttctccgtcgttccttacaatacatgggagtacaaaaaaggggaacagtgtgaagtgaatagacatccattgacatacggaatatgtaccgtttttatcatcgccctcggtttgctgtccagaaccgcatacatcaccgccctattgcccggcatcataaacgcttatttaggagatgccttgtgggcggcaatgatttttacaggattcgggcttctgtttcggaacatccggacggaaacagccgcatttttgagcctctcgttttgctgtctgattgaatgcagccagctgtatcacgcgccttggattgacgcaatcagaagcagcacgctcggcgggctgatcctcggctggcaatttgtctggagtgacattttcgcctataccctcggggtatgcgccgccgcatttttagaatgggccgtaaaaagaaaccgccagtccccttcataatcggagcatgccgccgatatgaagggataaggaggtggaagctatggatatccctgcgttatcaatcgctatgcaccaagcatctctggcgcagaatgtaaatatcgctttaacaaaaacggtcatgcagcatgcacaggctgcggcggaagaaacagtgaaaatgctgccgtcccagcacccgactgccggacattcaattgatgtgaaagtgtaaaaaaagatgccggatgataaccggcgtcttttttttgcccgttgtacgtacaccatacccggcatacaggaataaggtaaacggaaccaacatttgaaaaggaggttttcctcttgtacgatcctttctatcatgaatacacagccgagagccacgaacgggtgccatatcattatccgcggccgccttattatttcccaagaccatatccatactatccgcggccgccttattatttcccaagaccgtatccatactatccgcggccgtatatcccgttctatccctggtattaatgtttgaaaagaaatgactgcagacaggaggcttcccctgtctgctattcaactttgaccgacagaatatacgggagagcttgaactttttccattaccgccgctttcccgcttttgcttttcacccttcccttcacttcaagcaccgccttattcaattcataggacgtaataagaattcctttttcctcaagagaagttaaaatatcatgcatgacggctttctcctcaatcctgaaactgacagacaaagaatgcgccgccggtttaaacagaaaatttaacagttcaagcccgattaacgccaaaatcgtgccgctgatgccgatgacatacatacctgccccgatcgtcagcccgatgcccgacgtagcccaaatccccgcggccgtcgtaagcccccgcacgacatgccgctgcaaaataatcgtgccggctcctaaaaatccgacgccgctgacgacctgcgccgccacccggctcggatcaaaggacgtatggctgttggataacaaatcaaaaaagccgtatttggaaacgatcatcatcaaggcgctgccgacggccactaaaaaatgcgtcctcaaaccggcttccttcgccctgaattctctctccaatccaataagagccccaagcagacccgcaaccgccagacgaatcacaaaatcaagttccatccgtctctctcctttccttatcttcttacccgctttttatcccccgtatctttttctatcagcacaagactgccctgctgaaaaaaactgcatttgaatatatactttggttctttatcatattgtcagtgcccttatttatatgcggaaggtattaagctggcgtttccaaaataaaggaaataacttattgagagtatatgaaacaagtttattcgttgaagctgcggccgcttgtctcttccaatcttctaaaaacagaacgaatgccgctccctcatactcaaaaattgctttcaatccgcaaaaatatatcgtaatataagatataatcttaataaacgatagaaggtggatgataatgtcaaacgaaatcatgcgattaaatgacctctggacagatatttattaccggctccgttatcagcaccatgaaaaaatcactcaccaaggtgtacggattctgcaagtcattcaaaaagagaaggcagtcggaataaaagacattgccgaagcgattcaagtatcacataataccgcttcggaacatataaagcggttactgcagaaaaagtacgtttataaaaccagaagtgttgaggatgagcggaaagtcattttaaaacttaccagtttgggggcggatgtcctttaccggcattccggtcttgatgaagaaaagcttaaacagcttctttttgacagcatgaataatgaagaaagaacacttgtcctaaaagcattcagtttgatgaaggagcgtgctgaagatgtttacgatcgttaaaatcattgtctccgctgctattattgggattatcactgaaatatcaagaagaagccccagttatggaggtataatagcggctttaccaattgtcagtatgctgagcatggtttggctgtacatccaaggcgaaacgaaggagacattaagtcattttgcattcagcgtggcttccggcatcccctccacagtcattatgctggtcattatcggcatcgcccttcgccattcactgtctttcattgccgcatcagggcttggacttacaggatggctggttttcttgtatgctcaggattttatcgtaaaacatataaacagtcagcaataagcaccttagcgcttgtttgtaaatacgaggaattaaaaaaacagggatacccctgtcttaaaagtgactccgattaaaaagcgaaacccctttcttcacgagaagcagacaccgccgaacacaaaaacatcccgtgttgcgaacggagtccgcagcctgtacagccatatcggcatgaagaaccggctgatctctcaaacagaatgtccggcaatcacctcaaaaaacgaggtgaaatctgtcagtatcccgtcatccgccagctgtttttcttcaaatagcgcgcggttttttccgagcgggtcaatggccataatcttgcctgcacctgcttttttcgccgctgtgagccccgaaaaggcatcttcaatgactaagcattcttcaggcctgaggcctaacttttccgatgcgatgagaaaaatatccggcgccggttttccggggaagctcccgtcatcaaacgtgactttgtcaaaatcaaaccaccgatccaactgaaagacgtcaaagtaaaactcgacattttcctttaccgtagccgtggcaatggtcatcggcgtttctgattttttcagatggttcaatacgccggtcagtcccttcgtcagctttaactcatctttgttttcaaggcataattctctgtagtaggcttctttttcaaaagacagcttcttgatttcttcatttgttaaatcgccggaaataaaatacgtcaggatttcactgtttgttctcccgtgaatgttaacgaaaatgtcttcatcagaaatggttttcggcgcgtattttttcaccatgaaaaaccatgctttttcgtgcagatgcgaatcttgaaacatcgtgccgttgaaatcaaaaataacccctttcatcgaaccgcccgccttttttatttttttgcgattttgacatctacatattgctcgtaatgaatttgaacatctttcatcactttatcatccgtaattagataatccatatcgtgcaagttatagaacacgtaaaaatcttcccggttgaattttttattatccgccagcaaaaatttcgtccgcgaattattcagcgcgatttgatgggcttccccttcttcaatgctgtaagaagaaatctcatcattatgtatgccgttggcgctgatgaaggctttcgtaaaattgaatttctgcagattgccgttcacgatgggcccgacgaaggcaccggtattttttcggaaatcgccgccaatcagaatggtatccgcagtgtcaccatgctttaaaatatcaaatacgggatagttgtttgtgataatcctgattcgcttatgcagcaggtgtttggctaaaagttcaatcgtcgtgccgggccctaaaaaaacggtatcgccgtcatttacatatgaagctgcgagttccgcgatcttccccttctcatccatttgaacacccagtttttcattatgcgataattcgtgatcaatggaataagatatgctctgtgcgcctccgtgaatacgtacgatttttccggccttatccagctcgtccagatctcttctcactgtcatatcagaaacatccagttcatcgataatatcactcaccgtaataaatccccgcgagtttacgatatcgatgattttcaaaagacgctctttttttaacatgttcaatcatcccctcaactttacacacaatctaacacactgcggcaacccggtcaacaaaaacaaacactaacaaacaacataatcaacatataaaacagcgaaaaacttataaaacccctatgaaaacagattttatttctttatgaagctattgacaacaaaaatgtatgcgtttactattaaacaaaagataacaattacaaacattaacaaacttcaattcacacattggcgaaggaggattcagtaatgctcaaattacctcatgactttattttcggcggggcgactgcggcatatcaggcggaaggcgccacaaaagaaggcggcaaagggcctgtggcctgggatgaatttcttgaaaaacagggaagattcagccctgatccggcaagtgatttttaccgccagtttccggaagatattaaactatgtgaaaaattcggaataaacggcatccgcctttctatagcctggacgagaattttccctgacggcacgggcaaaatcaatcaggaaggtgttgattactatcatcgtattttctcagagtgccataaacgcaacgtcaccccttttgtcacgctgcatcatttcgatacaccgaaaggattatttgaccagggagatttcctcaaccgcgctgcaatagaagcgttcgtcagctatgcggagttttgctttaaagaattcagcgaaatccgatattggagcacgtttaacgaaatttatcccacagccaccaaccagtatttactcggggttttcccgccatctgttaaaagtgatatcacaaaagtcattcaatgcctccatcacatgatggtagcgcatgcgatgaccgtcaatctttttaaagacggcggctatccgggagaaatcggtgtcgtccactcattggaaacaaaatatcccgccagcgacacagcagaagaccgccatgcctgttttctggatgacgcgttatcagtgagatttctcctcgacgccacctacctcggttattattctgaggaaaccatgcgggctctggatgaaatctgtgaggcaaacggcgcttcatacgagttttcagacaatgactttgacgtgatgaaaaaagcttcaacgcgcaatgattatctcggcatcaatcattatcaatgccatttcgtcaaagcgtacgacggagaaaccgttattcaccataatggaacgggcgataagggcacttcggtctataaagtaaaaggaatcggcgaaagaatttacaaagaaggcctgaagcggactgattgggactggcttatttatcctgaaggcatgtatgacatgctgatgcgcatcaaacgggactatccgcaatataacaaaatgtacattaccgaaaacggcatgggctataaagatgagtttgaagacggcatcattatggataaggcaagaatcgactatttaaaagtctatttagaagccgtcagtaaagcgattaccgacggagtcaatgtaaaggggtacttcttatggtccttaatggatttattttcatggaccaacggctacaacaaacgttacggtcttttttacgtcgactttgacacccaaaaacggtatccgaaagaatcggcctactggtacaaacttgtaagtgaaacaaaaacaatcatttaacgatcatacatggtgaaaagagtctcttttcatcatgtgtgccgtctttaggaggttttttcatgacaaaggaagaattgcagatgctcggttttgaaatcgtcgcctatgccggcgacgccagaagcactttattgaaagtcctgaaagaagtccgtgccggaaacttcgaaaacacggaagcagcattgaaaagcgccgatgaaaatttaaccctcgcccacaatgcgcaaacgaaaatgttagctgaagaagctgaaggcaaggacatggaattaggatttattttcgttcacggtcaggaccacttgatgacaacccttttgctccgtgatcttattcaggattttatagaactctaccgaagctgccgataaggagtggaaaaatgaacggtatcatcaagcaaatcgaaaagggaaaaccgttttttgaaaaaatctcaagaaacatttatttaggcgcgatccgcgacggcttcttaactgccatgcctgttattttattcgcgagcattttcatcctcaccgccgctgtgccggaagtgttgggtttcacttggcctaaaagtgtttctgaatggctttggaaagtttataactattcaatgggcgccctcggtctgatcgttgcggcaacaagtgcgaaatgcctgagtgaatcaatgaaccgaaaaatgccgaaaaacaaagggatcaaccccgtttcagcgatgcttgcttcagtcgtcgggtttctcattttaagcgtcactcaaattgatggcggattctccacggaatacctcggcacaaaaggtcttttagctgcttttgtatccgctttcataacagtgaacgtttacagattctgcgtgctgaaaaatattacgattaaaatgcctaaagaagtaccgggtaccatttcacaaacatttaaagatgtttttccgttcgctttttccgttttggccatggtgatcgttgatttattgatcaggaacacgctgaacgtatcgtttgcggaggctctctcctctctcttatcgccgttttttaccgccgcagacggttatctggggatttgtgtcatttggggaatgatggcgctgttctggtttgtcggcgttcacgggccttctattgtggaaccggccatcgcagctattatttacgcaaatgtggaggcgaacctgcagcttcataatgcaggtgagcaggcgtccaacgtgctgaccgtcggactcgggaacttcgtcggcacaatgggaggaaccggcgcaacccttgtggttccgtttatctttcttcttttcgcgaaatccaagcaattgaaagctgtcggaaaagcatccgcggttccggtgtctttcgcagtaaacgaacctctgctctttgctgcgccgatcattttaaatccttattttttcattccgtttgttgtaacgccgatggtgaatgtctgtctgtttaaatttttcgtggatgttatcggaatgaacagttttatgtatgttcttccgtgggccaccccggcgcccgccggcttgattctcggaaccggcatggggctctcggcttttgtgctgacggctgtattaatcattgtcgatttcctgatatacctgccattctgtaaagcttatgacaaagtattagcggcgaaagaagcccaacacaccgagcctgaaaccgcgccgcaaacattacagcccgccatggccggcgcctccgaagacgcgtcctccgtcatcagcacaaatcttcaggaatcctcatccgccttggaacacagcaccaatgtgttagtgctgtgcgccggagcgggaacgagcgccatgcttgcgaacgcactgacagaaggagccgaagaatataacgtgccgattaccgcctcagcaggcgcctacggatcccattacgacatcatgaaagacttcgatatgatcattttggctccgcaggtcggctcttattacgatgacattaaagaagatgcggaccgcctgcaagtgaaactcatcgcaacgaaaggagcggaatatatcagcctcaccagaaattcacaaaaagccattcagttcatactggagcatacctcaaaatagaatcggaggtttatcatggatgccaaacttttaaaatcaagattcgaagacattttcaagagaagtaacggagaactgtttttcgcacccggccggatcaacctgatcggggaacatacggattatataggcggccacgttcttccatgcgcgatcacgatcggaacttatgccgtatgcgcaaaacgcggagatcaccagatccggttatactcagaaaactttcctgacagcggcattgtctgccttgatctttccgccacagcatacaaaaaagaagacggctgggccaattatccgaaggggatgatccattaccttcttaaagtcggcggccaaatagacagcggaatggatattctttttcacggtacgattccaaacggagccggtttaagctcctccgcttctattgaaatgttaacaggttccattttaagaaagttattcagcctggatgtttccgatactgaactggcgcttatcggaaaaagagtcgaaaatgaatttatcggcgtgaattcaggcattatggatcaattcgcagtgcaaaaaggcaaaaagaacatggccattctgttaaactgcgataagcttgagcacgaaatgattccggctgcttttaacggatataaaatcgtcattatgaatacgaacaagcgccgggagctggcggcttcaaaatataatgaacgccgcagcgaatgtgacgaggctctttcagaactgcggcaatatcggaatatcgcctcacttgcggaattgacgggagaagaattcaacgaactcgaatcccttctctcctgtgaaactttgcgtaaaagagcccggcacgcggtcaacgaaaacgagcggaccctctcagccgcggaggctctcaaatcgaatgatttgaaaacgttcggcgagctgatgaatgcgtcccaccgttctttacgcgatgattatgaagtgaccggtgacgaattagacgcgctggctgaagcagcctggaaagaaggagcactcggagcgcggatgacgggcgcggggttcggcggctgcgccatagccattgtggaaagtgaagaaaccgccggctttatccgggccgtttcatctcactaccgcagcaggacaggtcttgaagcttctttctacatcgcggatataagcgatggcgcggctgaatggagggaaaaataaatcatggcgattctcgttctcggcggagccggctatatcggttctcatgcggttgatcaattattaaacaaaggatttaaaacgatagctgtggataatctccagacaggccaccggaaagctgttcatgaaaaagcagttttttaccatggagatatccgtgaaaaaccgtttcttcgctctgtgtttgcgaaggagaacgtaacaggcgttctccattttgccgctcaatcccttgtcggcgaatcaatgaaagaccctctttcatatttcaataataatgtgtacggtacgcaaattacgctggaggtcatgcaggaattcggagtgaaacacattgtgttttcttcatccgccgctgtatacggcgaacctgaaaaagtgcccatcacagaagacatgcccgaaaagccggaaagcgcatacggcgaatcaaaactcatggcagaaaaaatgctgaagtggtgtgaaaccgcctgcggcataaaatatgtctcgcttcggtattttaacgttgccggcgcgaaaacggacggttccatcggagaagatcatcatccggaaacccaccttatccctatccttttacaaaccgcgctcggtcagcgcgaggaggttttgatattcggcactgactatgatacaaaagacggcacgtgcatccgcgattatgtccatgtttccgatttaatcgatgcccatattctcgctctggaatatttgcaaaacggcggagacagcggcattttcaatttaggatcaagcagcgggttttccgtatcagaaatggcggaagcggcccggcaagtgaccgaaagagacataaaagtaagagcggctgcaagaagacccggtgatccaagcgccctcatcgcttccagcgataaagcgcggaacattctgggctggaatccgaaacaaacggacatatcggaaatcattgcgtcagcatggaattggcatcggcaacatccaaacggatacaaggacaaatgaaatggaggcggcggtcattgaagtttttgaatcagtggcagggtttctgaaagaaagcactgtcttaggcgacataaatgaaacagatgtgatttatacaagaaacagacttctcgatctgctcggactgacggattatgcagaaccgaaacatatcaagaaacaaaacaggcttcactatttggacgaaatggtgaaagacgcggtaaaacggtcaatcataaacgatacgccggctgaaagagacatgctgggaagcagaatcatggacgtgatcacaccggccccttctctgatcaatgccgcgttcagcgaattgttatcagattgcccgaaaaaagcaacagattatttttatagactgagccaaaacaacgactatattaagacgcgggccattcgaaaaaatatcgtgtaccgctcatcaacaccttttggggcattggacatcaccattaatttatcaaagcccgaaaaagaccctaaagacatcgccgcggtaaaaaacagtccggaaaaccggtatccgaaatgcctgctttgtatggaaaacgaggggtatgccggaacaccgcatcaccccgcccgttcaaatcaccgcatcatcaggcttgacttagcgggagaacagtgggggtttcaatactccccttatgcgtattacagcgagcatgctatctttctatcaagcgtgcacaagccgatgaacatcagccgcgacagcttcagaaggcttctggccataacggaaatcttcccccactatttcgcgggatcaaacgcagacttgccgatcgtaggaggttccattctttcacacgatcattatcaaggcggcgcccatgagtttccgatggcaaaagcgggttccctctacccttttcatatgcgtcattttccagacgttcaggccgaagccgtgaagtggccggtatcagtgatccgccttcgcgcaaaagatccggatttgctgacagatgccgctgcgtatgtttttgaaaagtggcgggaatattcagacgaaaccgtcagcatcatcgcaaagacaaatgaaccccataataccgtcaccccaattgccagacgcaggggaacggattttgaaatcgatctcgctctcagaaacaaccgcacctccgaaaattatccggatggcatttttcacccgcatcaagatgtgcatcacatcaaaagagaaaatatcggtctgattgaagtgatgggactcgccgttttacctccccgcctgaaagatgagctggcagaagtgaaaaagtatttactgaatgaacctcatgacatcaaagatattcatcttccgtgggctgaaaacatcaaagcggataaagacgtgacatcggagaatgcagccgctgttttacaaaaagaaaccgcgaatgtatttttacgcgcactgaccgatgcaggcgtttttaaaatgacacccgaaggaattcaggcgtttcagcgtttcacgacgttattggagaatggcagctgaaacattcagagtgaaatcaatcaacaattttttttatcaggaggtattgtgatgttcaaaaaccgattgaaacgtgtatttgtaaacgcaatctgtctttctctcattttcactgcttttacattctttgagaagtctcctaaagcaaaagcggaagccccgtttgcctatggcgctgatataggatggctgaaacaaatggaggacgaaggtgtgcgctggctggatgacggcggaaaacagaaagatgccttgcagattcttaaagatcacggaataaatgccgtgagactgagagtgtttgtgaatccgccaagcagctattattggctgaaagacggcacaacatggaccatgctcggctatagtgacaaagcgggcgtacttgcggcggccaaaagggcaaaagcgttaggaatgaaggtaatggttgacttccattacagtgatgtgttcgctgatccaggccaccagatcaagccgaacaaatggaacggttattcaaacagccagctgcaggcagccgtgtataaccatacgtacgatgtcatgaaagaacttaaaaatcacggcatctcccctgattgggtgcaagtagggaatgaaatgaattcaggaattttactgcccgacggcagcacgaacgatttcagcaaattgaccggcttactgaacaaaggctatgacgccgtgaaatccgtcagcccggccaccaaggtcatcagccatttggcacacggcacggacaacagcctattcagatggtggtttgatcaattcattaaaaacggaggaaaaaccgacatcatcggcgtttcgttctatccctattgggaaggcaagccgtactgggagctcaccagccatttatcatctaatttgaatgacatcgcctcacgctacaacaaggaagtcatggtggttgaactgggcggagatgaaaataatccgaaagattcctactggaccataaaagacaccataaaactggtgaaagcggttccgaacggcaaaggaatcggcgtattttactgggaacccgaagctcactccagcgttctgtcagacgcgtacccattaggcgcaaccgccaaagtgtctaaaaacgtcttgaaatacacaaccgcaatcgacgcttttcatgatgccgcaacaggaaaatgattgatgcgaatctcaagcaggctcattgtgcagcctgcttttttataaggctgtagtgttggcctgttatgaaacagagcaagtaacgaatacggaaagaaaaatacccgaaaacccacgtttcggttaaaaagccgctttttaaatagaatacttcttctgttccccctccttcttatttctgcgcactatctctcagttcctaaataataactttacgattgttgaaaaagaaacaaacattttataatattgtgtaagcaccaccgagcaggaggacgggacatggacaaaaaagaacagctcctcacggatttcagggacttttttaacaagatggtgtggctgaataggctgaagatggaagaaagccttaaggggcataaaccttctgaagtgcattgcatcgaattcatcgaaaaaattgaagacgccaatgtgactaaacttgcggagtccctttatatgacaagaggcgccataagtaaattaacgaagaagcttatcaataaaggccttattgaaagctatcagaagccgcttaacaagaaagaaatctatttcaggcttactgagcaaggaaaagtcatttataaaattcacgaggaattgcacaaagagtttcaagaacgggacaaaatcgtgtttgaacaagtaactgatgaacaatttgacacgatgctgaacttcgtggaaacatacagcaggcatttggattcagaaataaagaaacttggtgcagacatgaaatcggaataaatatgaataaaaccataggcagcccttctccatgaaaacgggctgcctttttatatccctcttattgttgacaaagaaacaaaatcactctattattttgttgacaaggaaacaaagacagcaattttgagaggagagtaatatgtcaacacataaaagaaaggaacttcgggtgccaaaagaagttctcacagccgcctgggctattgcactgggagcaatcgctccaatgcttgactctacgatggtaaacatcgccatcgacaaactgaccaaagacttcaacacgacattggataccattcagtggtccgttacaggctatgtcttagcacttgcgattgcagtacccgtatccggctggcttatgaataaatataacggtaagaaaatcttcatcggctcagtcatcgcctttggtgtcatttctgtttttgcggggatgagccgtgacgtttccagcttcatcttcttccgtttgcttcaaggattcagcgccggtattatgactccgcttatgtcaacactcttggttaaaacggcaggtccggaaaacctgggaaaagtgatggcaatcgtcagtacccctatgatcttcggcccgatcttaggacctgtcatcggaggcttcatcgtccaaggcgcttcatggcattggattttttacatcaacgtgttcatcgttttgattgctgcaccgcttatgatgaaaaccattccagaatttgaaccattcaacaaagatcgtaaactcgatattttcgggattatcaatttgtcattaatgagcgcggcattgatgtacggtattacaaaagcggcggatcatgcatcatttaacaatagcgacaccattttatgggtgggcatcggtcttgtttcagcagtcatttatcttgtatataatctgatccagaaaaaccaaaccgtgctgcctatgaatttgtttgcaaacaagagcttcttatcatcttcgatcgggttgttcttagcgaatgttgccatcatggggccgatgttaatacttccgctgttttttcaaaacattcgtcatttcacggcagccggagcagcactcgctttaatccctcaaggagtcggaatgctcgtgactcgtccgctgatcggaaaaatgattgataagatcggtgcgaaatacgtggttacggtcagtcttgttctttcgctgatcggatctatcccgcttatttttatcaccgataacacaagtatgatttggatttccgtcgtattatttatccgcggcaccagttttggaggaattatgctcccattgatgagtgacgcttatacaggtcttgacagcaaacagcttccggaagcgggtgtcggtattcatatgattgaaaacctcggttccagctttgggtcagctgtgatcgcaaccgttaccgcaactgtcatacaaggattgcagccgacgatttcgaacagtttaaaaggctaccatgccggattcttagtatccgtcatcatccttgcggccatcttcattccaagtctgttccttacccataaaaagactgccatataaagaactttttaaagtaaaaaacccttgcacagcaagggttttagtgaataaaactgatgatggttgccggcagagtcagccaacaacagacaaagccttttactcattcacattgcttttcattaaccattctacttccgttaattcttgtttttgaacgtcttttgtatgttttttcgtaaaatggactttaacagcttcttcgttttcccaaatctcccaaagcatgagtttgcgttctgatggttcgagcggataagcatggaactgaatacagccttcttctttgttcgtttcttcctcaagttttttgaactctttcattatttcattaaggtctttatcactgatgatttttaagcatgccgttatgtaatgcatcgaaattccccctcttcccatctttttatggctttacattataacatcgaaaccggcataccgcattctcaacatataaaaaaccgtccataaaaaatgttggcaatgtttatttaagagcatttagagcgacttttgcagcctcagcgataagagcattattataattggcatcttccgtaaaccggtttgacaggattgccaaaacaattggggctctgtcaggctgccaaacgatcgcaatgtcgtttcgtgtgccgtagcttccggctccggatttatcgccgacttcccatcctgcaggagcgcctgcccgaatcagttcgtcgccggtagcgttgccccgcatccaatctgttaaaatcgtgcgcttgtcagccgtgagagtgttactcaaagcgaaagtcttaaggtcagttgccagtgcttttgcggtgcttgtgtcacgacgatccccgggaatcgcagagtttagatccgtctcgaatcgatcagctttcgttacatgatccccgatctgtttcaatgatttttcaaaacctttgggaccgccaagctgctgcagcaataggttcccggcggtattatcgctgtaacggacagcggcttctgagatttctttcaggctcatgcctgtatccaggtgtttttctgtgattggagaatatgtaactaaatcgtctttgctgtagcggatgatggcattaagtttttcatttgagcttttcttcagaacagcagctgcagccagaactttataggttgatgcgtaagcaaaccgttcattcggccgataggcgattgtcttgtttgaacctgtatcaatcgcataaacgccgagcctggcatcaaattttttctcaagctgaacaaatttttgattcgttatacaacttgtcatttttgtgttttctatagacttcgcttcagcatgcgctgagccgaataaaggattgaaaccggtaaagcttaaacataaaagtccaatgcatagtccaacttgtattcccgctttatttttcacatccagacctcctcattaaaatgattttgtatacatcttctaattaacattacaaacaggatgaaagtcaatatatttcctttgaatgattaaatcctgtattctgattcatccccttatttgcgcttaaatgcgccgcccttgccgtctgaatgtttgcatttccgcttcgtgttcatcatctatttgttatccctccgtgcaaataaaaacggacaccagtcagagcacagtgatgctgtgcaatgatcagtgtccgcaggctttccgtcttggacctatatatgtttctcttgcagactataaaaatcataaggtaagttaacaaacgcattaccttaatcctgccagtcaaaaaattatatcattttatatatttcaataagattattatctggatctctgaaatgagcaactcgtgcacgccattcctgacgatcatgtggttcattgacgcatttaatcccttgcttgtgcagatagtcatacgttttatcaacatcttctaccttaaactgaagcaaaaatcttgattgcgcatctccgtctaaagattttctttcttctccaactatttcagccatattttctcgagataaaagctctattttcgtttctccattatcgaagagtgcatattccatttccttctctaaccaactgattggaagtcctaatgaatctttataaaactcgacgcttttcttaaagtcattaaccaatagtctaatttgcagcaatttcatattgaacgcctcctatcattttactggccattcatttaatcatacaatagggacctgacagcattatgtcaagtttccataaatttttttccatactgcacctaaatttcggatgaaagccttcggagattcatgaaactgcgtttgatcaattcacattcttggtttgaattttccttcacttcaccgtggaggctccggccgtgtaagtcgcgcatccgtaaacatccggccgccgctcctgtaagtaaaacaactgataaatgattgactgaatcgtttttcaccgtcattgcttcccctgttttttgtattctgcgatttccttaggggtagccttccggactccgtctgcgtctgtcctgtttgccacttgagcgccttccatgttttttatctcgctgactactcccaaatgctctaaatacacatgatcaccaatcttgaaacgattcagtttagcccgctcctcggtcatgctcctgtattcagtcgcggctttcatttttaattcagccagacacatttgacaaagggttactgttacagaattgccgttaaaatcagtaaacgaaaccgatctgacagattccttttccgggtgcatcgtgcatgttttcttcataggcgatggccgtgtaaatttaatcattccgcttcctcctcaaaaaagtcgcttcgtccctctgacgtaacagcggatgaatgggaagttccatacacccgcatccgaaccgtcacaatacatggagattgcctttccttcgccggctgacggatattcatacatcctgcatagctgtaaagcctatatttctttatattcccaatgctcgccgcatttccctgttaggatgaagtttctaaagctgttgaccagttgccgcatgttggctccatgcgaaaagccatgtggaccgccgtatcccaattcatacgggtaattttcagccctctcatatgtgtgtatgctttttaaaggaggtgcatcacatgatgttctaacaacccattcaacctaaagctaactcttccccaattcccgatcataaaataagtaaatttacccagaacaaattaatcattttgcactttcaaaatacttatttgtctttcccttcattcctccatggtaatatcttgttgaacctttttaaaagaaaggatatggtcatgaaagttttcgaagcaaccaccctcctcgccgctgccaaacagcgtgcgagtgaatacaaaaaactgcgcggccagatggtcaatctaaaaaaagcgtttcaaggcatggctgatcttggtgacggcgatttctcaggccggggcgctgacaacatcaaagcttttttcaaagaccacgccggcgtcacagacagctggcttgatctgatcgacatgaaaatcgcatttctcacaagccttcccggtaaggtcgaagatgccggactttccaattcgcatgtagaggaatcatttctagagcacgagctcacccatgccctcagtaaatcaaaggcgattatggaagagcagaaaaaggacatgcgctccatcctcggagagatcgaagacattatctcgctcgatctgttttcaaccgaaagcacagatcaggagctttcttcagctgacaaaaaaagaagcgaaacgatacataaactcggcaagctcgatcacgatctaatgaaagaatacgcagaaaccgaagcgaacgaacagttcatccaagctgacttccagcagcttcaaaacgccacgggcaaaggtaaaagcgccacgccgcttcactacaacgccaaagcgtatcgtgaaagcgacatccataagaaaaaaggcgatatcgcaagactttcagatgcttatttgacgattaaaaaggaagaagcgaaagagcgtgaaatcaaggatctgaagaaaaagctggccgatggtgtcaccgatccggatgagtatttggaaatcgcgaaaaagatcggctatgaaaaccttgaacccgctcaggtgcaatatgtgatgcagcttgaacaagcaaaacagctcgaagaagtcggagaaacggcttgggatatcgtcaaaggaataggcgtcggcctttatgatgtcgggaaagacaccataacaggcgtcaaagatctggctgtcggcgcatgggatttttaccttctctctgatgaacaaaaagtcgctaaaaccatatcagctgtattgaacacaccctcctacgcaaaaatcatatggacaaacctggcggattcgtggaatgataaaatggttaacggggatgcgtattcaagatcacattacatcacctacgccatcgggagcattgtcgggctcaaaggttccggctcagctgtaaaagtatcaagcaagctcgccaaaacaggtgccgccaaagtggataacgtcttggaagccggtgaaaaagcggctgcaaaacatgtaaaaacagggattgaaaaaggaaaagactatatcaattccgtttcgaaaaataagtacgaacccgcacttgccggaatagcacaggatattgaaaatactcataatgtgaagaatacgcctttgttgaaaagtattattgaagatcagaaagagagtgtgctcagaaaatctgtgtcttctgacaatagcggcatacatagtgttaaacaaggagacagcagtcctctcgcaccaggcggtggcttagctgctcatgaagcaaaaggcggacaccttatagaaagacatgttggtaagactgatgaagagttattacagaggctacagataaacaagaagatacgggcctcttctagtttcactgataggccaactgcagaaagagtcgctaatgaaacattaactaaacataaaaaggaaattgaagagtggttaaaaagtgatgttaatgatccattaccgttaccttatagaggaaccgaagttataggtagaggagttcgtaaaggttcaaatgaagttaaagatatgactaatgctagaatagtattaaagaaaaatgaagatggtagctttatactaacaggctacccaacgaggtgatatataatgattgaaattaaagtttctgatcctgtatttagatttctcggtggacatttccaccaagatatagagtctccggaagatgcacttgatgaatatttaaatgaagcatctcaaaaactaaaagaaagagatttaatagcactaactgagtttgtaaatagtgatcattcagaagaagacaagaatgaatttatagaggaagcagcggatggtatatactttcctgaagatgatataactccattagaatggcttaagcaagtcactgaacaaattaaaaaacatcttaaaacaacatagttagagaaaaagagccctcttataagggactgaccccataagatgagacaaataaaaacaccttcaagtttgaatacggatgattgttatccgaaattagacttggaggtgttttttctatggggacaagagtgagttatccggttgaagcgaaacagaaggctgtagaaatgagattggcaggcgtacctatgaaagagatcatgcaggagttgaatattaagaataagacacaggttcagacatgggttagatggtataaggctggtgatacacatcgattcgaacagcctgttggaaagcaatacacttacggaaaaggtccggagtattcttccgatttagagaaactgcaggcagagattcgttacctgagacaacagaatgaagttttaaaaaagtacaacgaattggaaaggaagttgatagcgaaacgtcagtcgaacttgtagaaatattgcacagcacaatgaccgtacaggatatctgtattcatttaggtatctctcgagcgtcttattatcgttggaagaagaatctgatgaaggatcatcccaagcgccatttggaaaaacaaatcggcacgttgtgccgagagcacaagtatcgatatggatatcgaaaaatcacagccatactaaaaaagagaatgtgtattaaccataaaacggttcaacgtattatgcagaaaaatcaatggcagtgtcgggttaaggtgaaaaagcgcaagaaggatgggcagccatatgccgtggtcgataatatattggatcggaactttcagtctgatcgtcctcttgaaaaactagtaacggacatcacatatttgccttatggacagaaacaattgtacctttccagtatattagatttatacaatggagaagtgattgcttttactattggggataagcaggacacagcctttgtcttagacacacttgatcagctaccaatgctgcctgagaactgcgtgttacatagtgaccaaggttctgtgtatacatcttacgagtatcaaaaagctgttaaaacaaaaggcattaccatgagcatgtcccgcaaagggacgcccgctgataatgcctccatcgaatcgtttcattcctcgctaaagtctgaaacgttctatcttaacagcattgatcgaactacgactgccatcgtagaacgcactgtcatagaatacattcattattataacaatattcgtattcaaaccaaactaaacaaccaatcaccgataaactatcggcaattggctgtttaaaaggtgttttgacccctgtctcaaaaacggggggcagtcccataagaagggcttcttttattaattcaatttcgctttcgtttttggtccgtaaatgccgtctggcttcaaaccatacatgagctgaatcgtactgaaacgttcagccgcatttactgatgtaagtgtatttgaataaattgcagaaaaaccctcctcgtcttgagaagggctctgacttatacttctttttctctaaatcagtccgaagcaaaaaactgatgccgctcaacttttcaatctgcccctatgcttttcttttgctttttgttttctgattaaatatttttgttcctttattttttctctttattttctattcagttgttttttcttttcttgtttcaagctcctgttttatcgctttttatgccttagttgatatcccgatatttttcatctctttagaagcttgtcgttgcaatctttttgggtttaatttcttagattttgctttaacacaaacctcttcttgtcagtgtgggagagagtctgtaaaaaaggaaagggtctccgcttattttaacaacacttcaagttttactttggttcaagcgcataaattccatcagcttttaatccattcatcaattgaaatcgaattactgcattcgctgtcttcgctccatatgcaccatcaatcccgaagttctttcgctataatgaagggcgacagcgccgttcgaatctgttttacgctctcccctcggattttaatgggttttcaactttaaaaaaccggaagacaagaggaaggatgctttcttgccttcagatgaagagccccctgaatcacttctttatcatcgacggcaaaatgatagcttgtcgattcgctgttacccgacatataactgatttcattggcggccgcatgcgtcatttcctgtattgtgaatgattttcggagtgccgctgtatttgccataaaaaactaaatattccgtttttcaaatacaaaaaaacagctggattaaccagctgctgatcgttatcactttagccgttcagtgatacgaaatttctgtatttctctgaaatgaacaggtttcggcaaagaccgccgccttaaaggcgatgtttatctcccttgcagtatacagcgaatgtacttcaaaatcagcccaaaaagcagttccgtccccaattcgcccctcgatgaatgatgacaaaatcaataaataagcatcgtcggactaaaaggttccggctcagctgtaaaagtatcaagcaagctcgccaaaacaggtgccgccaaagtggataacgtcttggaagccggtgaaaaagcggctgcaaaacatgtaaaaacagggattgaaaaaggaaaagactatatcaattccgtttcgaaaaataagtacgaacccgcacttgccggaatagcacaggatattgaaaatactcataatgtgaaaaacactcctttgttgaaaagtattattgaagatcggaaagagagtgtgctcagaaaatctgtgtcttctgacaatagcggcatacatagtgttaaacaaggagacagcagtcctctcgcaccaggcggtggcttagctgctcatgaagcaaaaggcgggcatcttatagaaagacatgttgggaaaacagataaagaattaatagaaagactgaaaactgatcctaacccacatattacagcttcatctacttttaaagatagggctaccgctgaaagaattgctaattcagttttaaacgatccaaaaaatataaagaaaatcgaaaattggattgatgatcctaaaaaacctaaattaatgttaagatacaagggcgatggagaaataatcggcagaagtgtatcaagaaattcagatctagtagaaaacgttacaaacgcaaaaattatactcaaaaaagataataacggtaactttatccttacaggatatccaaccaaatagaaagagaggaagtatcatggatgaaaggtatgatttcttagatgaattagaaaattttttaggtgcaacatttcatcaagatatccaatcccctgaacacgccttagacgaatttattgaggaaattagtaaagaaggtttgctatttacagtaaagtattgcgaagagtttctaaatagcgatctaactaaacaagaaaaggaagacattataaagtgtaatgcagaaatatatttcccgacaattggcttaccgcctatagaatggttgaaaagtgtaatagagcaactaaaagaggctatttaaaagaaacactgaaaggcccccattttatgagagggcctttttatattgataccgaatttttcggctttcttatccgatagaaatgcaataccgacagtgcggtttggatctacttgacggcatcactagctgaacttttcaacaattttgcccctaaaagagatacgaacaataaatttcgagccgaaaaatcaagttcgccaacaacttgcgaatttgataaaccggctttattaagggaaagtaaaaaacccttgctacgcaagggttctggctatgattccgactgggctcgaaccagcgacctctaccctgtcaaggtagtgattatcttctgatacgaacagatgttttattttaaaaccttattttataaggttttctgaccagtctttctgataaaaaatcttctgttttggctaaaaatgaacaagttggtccccaattcgtccccaaatcagatttattgacaacagaactaatgttcgtatatcatccttgcaggagttgaatcgcaatgaccgattttgaacggaaagtatatcggattatttttaacatgacccgcttcgggaaaaatccctccatggaacaattgaaaaggaaaaccgggaaagatgagcagacgatccgtgctgctgtgaagaatttgatgagacagcgcattttgaagtgggataaactaaagaaaaagtggatgttttgacacattacacattacaataaagttaaacaaaggatttaataggagatatatttgagtctctttataaaataggtgcctattcgactgctaaataaaagcataaaaaaagcttacataaaagtaagcttttttaagagaaaaaattttgccatttttcaaaagccgaaattaaattcactgagttagaagcagtcttaattattgaatctgctgaatctataaaacttttcaagactgctttctttggtttttcagcagttatctcagaattagctgcgtccacaagctcatttaattcttcttgcttttcaggattcaattctgaattttttatctcagcaagaagtaatttagttacttcctcgaattcagtatctccctgattgttgttattcaccactgtgttattagaatgcgaaccaaaactaattgcagttccatttgggttatgaactgtattatgaattgttttatccacgtagatgtaaacccctttcattttctcttcaaattgtccgttagctatcagttcttccatagttttttctttatctgttagactaactggagcctcccgctccagttttcgttcaagctgggcggtttcttttttttttgacattgagatataaaataatcagtgaattcaaagactaacaagaagttctctggctctggaacaaagtctatttcaccacaaatacagtcaaaataatcctcaatgttctcttccaaatcaaaagatcgaaccttatgattatttggacacaaaagcatttttttaggtattaattcaaaatcctttttactcattaaatatcttagtacaagatcataagaatcgttatttactccgatagcgaatagaacattttcaacagtgaaatcttctattggaggatcatttgcagcccactttgataatacactattaatatcttcaaaatatactgtgctcataattccccctccaatagttttttactaattaatcgatatgtctttttctatagtttccgcagtagacgccgcctcaattatagaagccatttttttatcttccatatcaaccttaactaaaacatctaaaacatgatcaacaacagtctcaggtacttccttggcaaacttaaaatagccctttccataattaacttcaaaagtggtttctatttctacggaagtccttggatcagtatatttgaaaatacacttctcgtccattttatgatctgttggataaccaagctcatttattgcagtagtaattatgttaaaggttttatcactatttaaatcaacgcctcttttaccgttaaattgaatacttcctacactagtaggaagtgcaatgtgactggaagaaacacctgccgaaagatgatcacacattctttttgcgttttcctttgtcaatttcggaacggtaaagtgattacagtcttttgaataacctataaattctaacacttgttttctatatttaacaatatctttaaaagcacatctcatttgcaatagaggcttatcagcaaatattacaacaatagagataaaatgagcataagagactttcatagaaccgtatcctttttttcgagttgagcttttttcttctacaaattttaagtagacggcacttccttcatgtttaattgcacacaattgtaattttggtctaaggtccggctcccactccgtatcaatttgatttgttctaagtcctcttttcccaactaagaatttcaacagtttttctggagtatttgaagtctcaggaaaggggtcttcaagttcacacaacgtcaaatgcttacttgaaaacttaaattgctcatctaaatatctcaaatcatcccggtagcctttttcagaaagctcgtcaataatttcaacagcgtcacggttaaaaaacttaactttttttgtttttgcaaattgatttaaaattgtgctcttttcaactatatttaaatatttctgcatatagacctgcccttcactatatccaataataaagagcactaaactatacttgaacagtaaacaatggtagtatcaagttgtctaaagttaagtgctcgccccatcttaatgatggggttttcttattcaatattaacaaaaaatttacagcagttccatcttttcgttcaaatctctctttacttatagtaaagaaaagtatgacaaaaacttcaatcatcctacggccggtacttcttccgggcgacttccaattcttttttcagtgcttgtacatgtccaagcaaaaacaatgcaactgtcccaacttttaatcggcttgagcttcccggctgtcacaagggtgcttaaacgctgccgggtgactccaagcagctccctcgcttccgctacagtcttggataaacttaattttttcgcttcctttcatgtcgtttttctgaccaaatcataataagacctttgaaaattgtgaggatcacagccagatataaaattacactcgctatcattcccgaaagcgataagtttttagaatcaatagctacaaggccaaataacattattagaagcatggccatttctgatgtactgtacttgctgagataatctttcattcgaaagtggatgagttacagtataccgcaatacgtttttgcggcataccgcaatcccttttaatgtatactgagtgtatattcgaggaaacagggggtttccccccttgaaaaccttgaaacctgcagttgcgcttctagctttgccggcggaagcgctttttctttttctctcctcgctgcttcttttcattttggaagatgtcataaagctgtttgcatattgtgacaatccccgcaatggaaagtacccagtttctaaactcatccacttaaccacctcctaatacaaaaattataccatttttatccgagacaccaatatatttcataaaaaaaccactctaaagagacggatgctccgctagtcatttttacccaaccacttaaaatctgctttctatcaactttattcaagagcaacacaaggaataaagacgcagaccaaatgattcattttctccttttgaatcgtacagcgacctttttcttcattcttccatggtaaaatcttgttgaagctttttaaaagaaaggatatggtcatgaaagtttttgaagcaaacagcttgttgaccgctgccaaacagcgtgcgagtgaatacaaagaactgcgcggccagatggttaatctgaaaaaagcgtttcaaggcatggctgatcttggtgagggcgatttctcaggccggggcgccgacaatatcaaagccttttttcaggaccacgccggcgtcacagatagctggcttgatctgatcgatatgaaaatcgcatttctcacaagccttcccggcaaggtcgaagacgccggactttccggttcacatgtggaggaatcatttctggagcatgagctcacccacgccctcagtaaatcaaaggcgattatggaagcgcagaaaaaggacatgcgctccatcctcggtgagatcgaagacatcatctcgcttgatctgttttcaaccgaaaacacggatcagaagctctcttcagctgacaaaaaaagaagcgaaacgatacataagctcggcaagcttgatcacgatctaacgaaagaatacgcagaaaccgaagcgaacgaacagttcatccaagccgactttgagcagctccaaaacgccacaggtaaaggaaaaaacgccacgccgcttcactacaatgccaaggcgtaccgagaaagcgacatccataagaaaaaaggcgatatcgcaagacattcggatgcttatttgacggttaaaaaggaagaagcgaaagagcgtgaaatcaaggatctgaagaaaaagctggctgatggtgtaaccgacccggatgaatacttagaaatcgccaaaaaggttggctatgagaatctcacccctgaacagcttgaatttgtttcatttctggaacagcgtaaagctttcatggataacggaaaagaagcattgcaaatcataggtgatggcgccaaaggtctgcttgttggtgtatacgatcttgccaaggataccggtgaaggagcacttcaactcggatggaatatcggttggacaattgacaacttaaacaaagatcctcaaaaagttctggatactgttctggaatacgattatctaggtgtctatcaaagtatggttgacacattgaaggatgattgggataaaaagatgattcacggggatgcatatacacggatgcactatgttacttacttgggcggaagtcttctgttattgaaaggcggaaagtcctctgtctcaacaggctcaaaagatcttgctaaagttgggaaggcggctagcgaaaagattaaaaatggcaatccatctgtcaagccttatgccaatagatataccccggcattagaagggattttacaagacgccgggaatactattaatgttaaaaatacgccgcttttaaagagattagttcaatcaaaggatgatttgtttactaaagccgcaccttatacttacagagatgaatatggaaacctcaaaacagttaacttaaaaatgggccatctaaaaaaccaaaaacaccctaaaactggagttccatataataaagacggtttcccaattttcaaagcaaaatttgatacaaagattgattccaaactttataaggaaagcgattatttacaatttaaagatgcaaccttaaaattaaaagaagaaattgaaagagatcctttacttagaaatcaattcaatgaccttcaaatcgaaatgataaaagctggtgaaacaccagacggatatacttggcatcatcaccaagattcagggagaatgcaattagttgaccaaaaggtgcatcggcaaacaggccatacaggaggccggcacctttggggtggaggaagtaagaacagataggagttggtcaatatgacagagtggagattcgccgaagaacctatcggggaaacaactgttaaaaaaatcgaaaaggctttagatattaagtttccaaacgactacatttcaactatattaaacaacaatggagcacgcccaagtaaaaagatttttgactatgaaaatacaaaaggcgcggtttttaatcgattacatggtctaactgaggatagttcaagttttattttagaggttttagaagattatcaggatggaagaatgctttcagggatagtccctttcgcctgtgatcctttcggtaatgaaatctgtttcgattatcgtcagaataaagaaaatccctctgtggttttctgggatcatgaaattgcttatgaagaccctgatggagctttgagtcatatatctgattcatttaccgatttggttaataaactatacgatgaataaaaagataagtcccttctcataacgagaagggattctcttattttagtagagcttcaagcttcgcttttgttttcggcccgtaaatgccatcagcagtcaggccgtacatcacaaaaaaccctcctcgtcacgagaagggaatcattcatcatacaaacgatacttcttaacgctctgcctctgatttttttcagagcttatacattcaccaagaggaaaagcaggcatttacctgcttttagaacaacaatagattaatagcataataaacaccatcagcaattattttggccgatcctccgccaatcttacccttcaaagccttaaatagcttgtccgaaatcatatgtgcagtaacatcgggaagttcagctatttcatctatcttatctgctatgtagcctgaattctttttaaatgcttttgctgctttagcgtcggcatgttttaatatttggccaaccgctgctccgccatgtctaattcctaaggagactgtatttgcagctaatttgactagatagcctttaatgccggtagtgtggaacactggctcctcactctgttcctcagccaaattgttcacagtgttagtttgaacattaacactctgtgttgttcctttagtctcagtttgactattaggagttgcggcacttgcaacgcttggtaatagtgttgatactaaaagtaagcctgtgagagacagaataattacgcttgacataatccttttcattttaccacctccttccaatatagtattatatactaaaatttataatttttgtttaaaattagttaaaaaaggagacttatcatgagaaaaatttacaatcatatgaatgttgaccaaaaaaagactgctattaaattgtttaaagaggatttagaagaactgaagaaggagcagaaacaggaaggtgaaaagggttaccctcgggttgtaagagatgcaattgaggaaactatacaacggtacatacaagatatagaatacctaacaaatgacttaaaacaaaatgagcaggcctaatgcctgctcattttcatttcagaagcgcttcgatctttgtttttgtcttcggcccatagatgccatcagcagacagaccatacatggactggaaccgtttgaccgcatttgctgtcttcgcgccgtatgcgccgtctattccgaaattctttgcgttcttatccgggtagtaatgaagagccgccagcgccgtttgaatctgttttacggcctcccctcgggtcaatgggcttgtgactttaaaagtacccgctggcaggcggaaggatgatttctttccgttggatgaagagccggccgaatccctcagctttattacctggccgactctgattagattcggattcttaatgccgttcaagctttgcagggttttcatgcttactcctgttttctctgcaattacagaaaggacatcgcctttcttgacggtgtacgtcgccccgctggtctttgaatctgttttttgtggtttggatgcttttttacctccaaggcgttcaagttctgcagcaatggccgctttcacttcatcccagcgccccgcatctaaaatacggtgcgggcagtatttcccattccagtcctgatgctttctgattttgtcaacgccccatccgcgctcttgaagtaactgagcgacaaacttgatagccagcgcttccgctgcttggtatcgcgctccgcctgacttgctgtagcagatttcaacaccgatagacttacggttcccggttccgtttgtaccgtcgccagaatgccaagcgttctggtccagcggaatcccctgaattacttctttatcatctacggcaaaatgatagcttgtcgattcgctgtttcccgtcatataactgatttcattggcggctgatgcgtcgtttgctgtgttatggatggtgatatactccggcgtcattggattcgggcatttcagggcgtaattttcacttggaactaatctttttttgactgcaattgtcatgaaaaatctctcctattctgtttttggattcaaaaaaagcagcctgattaaccagctgcttgatcgtctttttctgttttctgatcgttgtcgctttcaattacatggagccggtcagtgatgacggccgggattttaacgccgatctgtgccaagttttctgtgatggacaggccctcatttgcgatataaaaaagaacggttccaaatgtcagaacaccgttcaaatttgttatcgtatcaataatgtttgcgacgatgaccaccataaaactgagcatcttccggacatatccaaaccacgcgctacggctccggagctgcttcattttccatgcttttataatgccagtgatgacatccaagatgctgaggatcaaaagcaagtcaaggtatttcacctccccgaaaagataggttcttgcgatctgtaagctctcaaaattcatccacacgtgtattccctccattttgtcttcacctcctccgaggcaaaataaaaacaccctctcaggtgttaacagatgaaaattctatttatttttcgtcttttctttctcgagttctttttttagaattgttatttcttcatttgcttgctttaatttattttccgtatatgaatgaagagctttagaatcagctaacttattatagagatcaccaatatctccacccaaagcattacattttagcgccaaaagctcacactgttcttttaatttttccgagctcaattcactgttcatcttctatagaaactcccctctgtttggctgttatttcatcatattccgcttgggtaatccatcctactgatactgccaaattcatttgcttggtcgtaacagtccctttgccccaacacctatcaaaatacttataagagttgcttttattcatttttgtaatactccctttaaagcaagctcttcaaacagttgattgacaagtatttgtgttaactcaatatctgatttagtatcgtcttcacctgaagatccctttatgatatggggtgttaattctttcaaaactcatcagccctttcacctgagtgatattcattattagaagcagcaccttctgcaatttgtatttgaaaatatttaggcagctcttttaaatcctcatttgttgatacagggaagtcgtcactttttgtaaatgaaaccccgtacgtgttgccatctggttccacataaaattcgagcaatgtccagaaaagcctctcgggtttgacaccattaataccaacgtcttcattaccctcaatattcttgatcagataatactcaaaatcacttttattatcttctccttctaatatcattaatttatatagagaaagagtatcttcgctttccaatgaaaagtaaaccgcatccatttgagtaacagtttcgtttgcctgtccactatttaaaatcaatttgaagtttgatacagttaccgccccggcatcttcttcaatttttaaacctttcatttttatgtcatcagctctatagttgaccatacccaacatatgaagcgcctccctaccttggttcgtaaatatacagaatcattaacctaccgacactctgaccttctacattaaccgttccagtgccacgaactctaaaagagatagttgctgatttatctccatttaaggtcatgctgggcacaccgcatgtcacgcagtctgaataactcccgtaagcttgtactgtagcgaaaaaaatgttttcaacatctgttccaatacttagagttccatcaccataagcagtgctcccgctgcctttatttatattgaaattgtcccaataatgaaccctgaggatcgcattgctttgtaagtctccccttacatcagttacagcgttgctgagggtcaagccaagagcttgggaagatagtttcagttcattcccagcctccaaacgaacgttataaggcaaatacaccgaatcgccgtaatagcccatataatttccatcgccgggtaaggtatcgtctctgtcaattttgaacatttgctttgcagtggcatccccttgatattgccacacttcaaacccaaagcgttcattctcagaaccagccttatccggacccctcccggtaaatattgcaacatttccccatttcgtagtgctatcattcgagttttccacaacaattttaggcacatttgtatcgtttggtgttgctcctgaccaatttgcaaaataggtcgatcttaattctaatctcccgtcccactttccattagcattaggtgatccacctataattgtttttctatctacaaaatctgcatttaagaaaggggcgctgtcagttccacttatttgtttcgctaatgtcagataatccttcgaccccattaacccaattccccgttttgatgtattgccagacttccaaacaggcgtcaaagagcctattatatcgtagttaggtttaaggtcatcagtacctggatcgtaaaacaatagattatagttatacatttgtatcgtttttctgccgtttaattcagacgtaatagtgccgtctttcagctcgatcgtatccccggaatcattttcacttcgaacgatgacacctgagagaataccacctttgatcttgtcggctaccagactattaatttttgcattcgtgatagctccgttcgccacattcaatgtatcaatagcagcagtaccaatttttgcatttgtaattgataaatcctctatatgattcgtaccaatacgaactgtggccgctgaatactggttagtgaaatcactcggtgtacctttagtattcaaagctcgaatgcgataataccaaacctgatcaacctcggcgtcatgaacgcaaccaccgtcttttcctcgccatatcaaagtagcgctagacggaacaaaaccattcatctgagacgcataaacttcgtatgcagcaatgtaagagtaaggttcgaaatcccatgaaagagatacttttgaaaaaagccctttcgcttgaacatttgtcggaacaggtggttttatgtctgggaaattttcatcggttattattatatttttaccaatattatttaaggagtcttcaattttatccagccgcgtgtctggttcataagcagaaagaaattgcccgatttccactacacaggtattatctggatcagttatgtcgtattccatcgaaataacccgttgcgatgtctcaattgggatagcgaagtttcgatcaattgctatcgtagtatctcccaattccacatgctcatgttcatatcccggaatgttttgaagcagttggaccgacaactcataattaacttctattttggatgctgtggttattaagtagtcatatgttgcttttaaaagctcttctggatctgttatattctcgttgttgtattcgccttctctgtgtattaaaacgtcatttttaagccggcccagctgttttaataaatccggatcaccaacccattcctggcctaaaggcttgtcgaccggatcaccttttgattttttccattctacttccgcaaagtcaataaaacgggaataaccgcccgtttcttctccgtcatcatcagtagatgcaatagatgccccgtatccccaaagggctgttactggatagctgatgacagttcgacgaatatttatcgtatccttgtcaatctcaaagcgcttgccgctgtccttaccacgtcgaggaagtatttttatgattcttctcgtgaccttattcccgtcaaattctatagtgtcctgaagctcgccgccccatatattgattacgtcagcaatacaatccagcgctgatttcttataaaaggtagttgaatttactccaagttcaacttttacctcagccacccaccttgaccgggaaaggacattatccagtacaaactgcgcagttttgttagtggggcggaaatctttgactctggtttcagcaagctccatcatggccgcttcacacgtaaccagagtgtttgtttccccttcttcgtctgtatcatccatttccttgatgacaaacagacgcaagttgccatccttatccctgaacactacttgattctcttgaaaaaggaatcttgcgtcaggatgggaagcatctgctacaaaagaaaaagaagaacccttgttaagctcttctttatattttgcctcccagaacatgcaggtttcttgtccgtggctggacagcactgtcaataattcatcatcgggtgaaagtatatacatgtcagccatggccggacctccttacaaatatgcctcattaaatttgatattgctcttatgactgaatttgattttcactggcgtctttggcggcagctgaaaccaatccgattgaatttgaagtgctggcatgatcaacttaccgctacatgtcacctttcttttcgctgaatcaattatgagagtgtcaccagcgatgaaatcgtacagcagcttgatcgttttcgataccgacccatcagcattaagaagagccacctcatatgaagtggctttctcttcaaaaacgcattcgattgttgggtctacagctgcatagcccggattagtaatagtttgaacacctgaatcaaattcaaaatccttcgccgggccgtatttttttggatcgggacagataaaagtcaatgttgcagtctgaaagcctccctgttcttcaccttctgaaatgctttcaaagacagcattatagactctgtcaggctcatcgtaaaaaattaacggcttaggctcttcagtgtgcagaataaaagtcaattcctcctgctttttcttcagctcttcttcactgctgaaggcgaaaaggacctcaatggttatgactcttacaggaattcttgtattgcgcaggaaaccgccggggcgattcccgatagtggctgtattcacttctcttcctgtcactccccggccgcccgtggacttcacataaaagaagggtgatatatcaatgccgtcaaacgtgattttccattggttaggcagcagttcctgataattaatcaattaaatctcaccctccttgcgttcgatcttctttgtgcgtctgtgactggcttttctactccttgaccgaccttcttgctgtccatctcaaccacaatcattctgtcaggcaattcaaggttccggatgtccgcgctcaattcttttctaacagtgccaagttcaccgctagaaatggaagtgtcatattcaaaattcatatcctcttgctgaatagtcatagcatcactgacggctcccatggctttctggacagtgccgataccgttctgaatcccgacagcgataccagcaggaaccatgataccgaccttgtcacgcattacccttgacggagaatggattcccaaaagttttttcatgccgttaggaatagcatttgccattgattttactttgctcgctaatgctcccgccatgccgctgataccttttattaacccttggatgatgttcttaccgatctgccacaagttaatgccgcggaaaaacttcatgacaccgttccatatgcttgtaattgttgatttcgccgatttcattacgctggaaatagcatttttcatactattgaataggcttttagctgtactcacgagccctttccagagccctgtcacaaaacctttgacagcgttccacacacttgtaaaaacactcttggtgccattcagcatgccgctaaaaaatgacttcaacccattccaaatgctcttggcagtagaagacacagctttccatactgtggtaacaacagtttttatcgcattccaaacggtgctgaagattttcttttgcgtatttagccaacttgtgaagaatgttttcaatccattccagatagtttttccaactgatacaacgcccttccagatcgaagtagcaattgttttgatgccgttccaaatgcttgtgaatgctgttttcattccattccagagtgatgaaaagaatgttttcaggccgttccaaatgcttttagctgccgatacaattccattccaaacagtagagaagaacgactttattccgttccatgttgatgttgctatcgtctttatacctgtccagacagtagacagccaactggaaatagcaccccatgccgcaattgtagccgattttaccgtgtcccaattcgcgatgatcaaggcaaccagaccgatgacagccgccgtaatccatccgataggccccattgcgatgacccaagatgccgccatgcgtgccgcctgtgctgccgcttgtgccgcaagcacgacgagttgccggccgaataaaaccatttgcttaccgcctgcaaccagcaaagatataaaattgctgatctgcgccgccgtccaagccgctgccatgcgagttgcctgcgctatggattgcgctgcgagcacggtcattttggcaatgaaaagacccatctgcttaatcccgtttgtcagcattgtgataaaagaggtgatcttcattgctgtccatgcggttgctgtacgggcagcacttgcgattgattgagccgccattacagtcatattcttgatccataaacccatttgaacaatgccgcgcttcagagcagaaacaaacgctgatattttcatggctgtccacgatgccgccattttcacagcattagctgttgcgcttgctgccatcgctgtatacttcgcaatgaattggcccatagcagctattgctgattttaattgggtaatcaatcccacagttctgatccctgaaaccgccgaaccaaagctccgcaaatattgagctgcagtcataaaatctttaagcccatttgtgagagcactaaccgctactatcgccggaacaatagctcttaaagcaccaattaatgaaataccggctgcgataaatttcccgattgccgggtttgcttccatcgccgcattagtaaatttcaaaaacccgtttacattctccaaaatcgtttgaccaagtggagccatgccaacaagcaagttgatgatagtcttcgcgatctgccccaatgtgctccacactgtgggcccgttggtcttgatataatcaatgaaagattgaaattcttttgttttcgtaacgctgccagcccactcattgaaccgcttggtcagatctacgagtgatgtcatcatgtcttgagacataggagcgaatccagtaaacagctttgtcaggccgcccgaaaagtttctgataatctgcagcagttttggaccattggtttttgtatactccacgaaagcctgaaatttctttgaagaacccaagttcgctgaccatttcacccatgattgggtcattccttcgatagattttgtcatgctctttccagtcggtccgaatgctacgatcagattgaaaactgtccgtaagacattcccggcagatcggccgaatgaagcaaacgccgccggagcttctttgttcagataagaaatgaatctctgcatgtccggagctttaaaagctttgtccatgcttttcgccagtcccacgccctcttttgccagtccatcaaacattggaatgagtgagttaagcgcgagtttaaacgtatttagagacataccgaatgttttcaagatcggcttttgaaccatcgtaccgatgtcccgccaattgtctttaaagtcttcgaggttctttaatgcctctctctcttcttttccaagagatttttgcagattattgatctgtttcatgattttagcgcgctcttttgcgcttgttgcattgtccagcttctcctgcagctttgaaaggtcttcggatgctttaaatacaccgcttattgaagtaacagcaagggcgccgaatgccgccgcgcctgttcccgctgttgcaaatgcactggttaaccccattactccgccggctgccaccccgagcatagggcccaatgacccgattactccggttatgctggcaagaaccggagtaattgcaggcaatgcggatgtgaaggcgccggcaagcgaatgacctatgacagttgaaacagagttagtgattttggcgagcctgttcattgatgtttcaaaccgatcaattcgggcttcgatgtgtatccaaacacgttttggcaaggaatgtgtctctgttctggctactgctaccgctctcgttaaattcgaagtatcaccgtttatgttggttgtgactctatttcgcaacgaagctaaagctgtccgtgcttctgacacagctctagtcagaggatctgaatcagcatctaaatcaactcgtgtgcgttcatgtcgatgtacaaaattatcaatttgctgctcggcctgccgcactctggcctgaaagcttgcgatctctgcgtcaatttctactgtctgatgatcattcatccggcgcatcatatcattcacatggtccatgctgcgagtaaatcttcgtgtctgcgcttcaactattgctgtcaatctttcgatcaattcctcaccccattccttgtccaaattttgcaaagtggttgcggattgtatcattaaaccgctgaacccctttagctcgcttgccgagctcgtttacatctgtcttgcgccatttgtcgttatccccagtgatgttccgctccaattgacgtctggccttattcgcatcaaacattttcttttctttggggcgcttctcattcatagcgtaacggtgaaacatggcgtttcttgccataagctccaattcatctatttctcgcaacttggcccctttgagcagaagcttgtactcgttaggagtccatgacatgattaaatccacatcataaaccccaagccaatgtgcggaattcgtaattatttggtcatagtcgatcccgttctctctttgtacgcctctttcatcatcttcaggacttccttgccgttctcttcgtcctccagccgtttcgcttccatttccggtgtttcgttcggagccggtttcttccctttgttcatcttctccatcatcttccatcgctgacggatcacgcctttgaaaaaacccgctgagtccagtgttgtgaatgcttcattgatcattttgtcaattgcctcgcctgtctcgtcttcatcaatgattttcatgattgcttcttcaatagcctcagttgaaggcttttctttcttcaagtaagcaagtgcgcaatcccaaaaagcagaaagataggaagcctcttcgttgagcaggctcatgtaaatattcattgtgccgcctttgcccttttcgtccgcagtggaatatttttcgtttgccaatctgtcaaaagcaaagtcgcagcgtgatttgtattctttatctccgatagttaagtaagccatttataaaacctccgattatttttgtatgttaaaaaagagcccgggaagcccggcccctatgattccttttctgttcgtatcgtaaaattggccgaacgttccgattccccgaccgagttcactgccgacacgttaaaaatgtaggcggtgtccggctttaggttaggattcgacgtgtacgaattctttgagacagtcgctatttttgcataaaacctgtaaatattgtaagatgtcgcccctttcaccgcatcccatgaaaaactcacctgatttgaagtggcgcttttcgcagttatattgcggggaacgttagggcgtaaccgcttgtgtttgcgtaacaatctcagtcattgaggactcacccgcatcgttcacagcagagacgttgaccgtgagtttcgtatcggccgcaattcctgtcaaggtgtgggatgtgccaatgacagttgcgtccagctgcttgctcgctcccctgtataccttatatgaagttgccccatctaccgcatcccatttcacggtcacgctgtcagctgtagccgtgaacgatagattttggggcgcattagggcgtagttgtttttttggcattctcgccaaactgcatgaactctttggcaccggcagaagatctgatctcgtcaattaattcttgaggcagaggatcaagctcacctttacgggtcttaccgagaacaggcaatgttgttgaaacctcaataaacccatcttgcggtgcacttttttctaagttctcgatgattgcatgtccatattcagaatcatgcttatcgtttttgtttttattcaggtttactttccatacctgaactgtctcttcgttgtcataagcatcttcaatcgccgtttgacccggatcagagacagcagcataatatgtcagttcgatgctctcagatttagggccgtacccaacaattcggccagactttgttgattcatcttttgtatcttgttctttcgtatgactgccttctgtttggaatgcgataaacagaccttcagttgaagtagcattcatcggttgaacaaagtaaacctcatcaataccattcaataaatctgccattttgttcatcctctcaattgtttattgtgaagcgcattctgagaatgccgtgacgcgtgtatccgtcaatatcagtgatcacctgcatgctgcgcatctcagaacggcataaagaaaagccctctattgttaggggcctgcttgttaacgcttgaagcatgaggctcaaaatctccatcgcttctttttttccgttgtaacctgaccagcagtgcagaacgacattgatttcttcaccgctggatgtcttggttttaaatggggaaacatcatcatcccccattgttacataaggcttttccagatctttcgggactgcatcaaagacgcctgtgacgcgcccgttcagcttttcgtctgttgataacctcttaaataaagcagcctgcaacgtccacagggcagatcgcatgatgacagctcctttctatcacatttgactggcaaaataccgcatgccttcgtccatcgctggattccagaacggctgtgcccgcattccccgcgtgaccacccatctattaatcttggtgtcataataaacccacggcgtttgccggccgccgccttcctctgcgtaaatccctgttccgtattccacatatacggcataatcggcaccaacagaaataacggcccgtaagccgccctcttggtagtcgatttcaattgaatttttcaggttccccccgtctattgcggcggtcggagcattcagaacagcgtggctgtaaatcagctcggccgtgtctgtgaccagttgcttaatatcatctatgacccggcttctgaactcgcttgtggctctttgcatctgcctgacccatctaccactgacctcagccattgcccttcagcacccccgtaacctgacatttcaaattcataatctcatgcatgccaccctggtcgatcggatctgatttgagagtcagcaccttgttttcgtagatgatccgcattgtcttctcaatatcattgcgatacgggaaatacacattgcaattaaccggattctgaagctgctgagcctgataatattcccgggacgtaatcccgccgacaaaagcctctgtggtgagataatcagtgattttttcaacatagcccccgccgacgtccggcaccttttccaaccgctgaaacgtgacaacatgcgggaattcttcatagatcatcggaatgcctttctgtatgggtacagattcttcatgatgtgttgcgggaagtccgtgttatacgaatacgacacatcccccatacttctcccagacagaccagacggcgtcatattgtattcagccgctttcgcaacaaatattttcacaccagcgggcagcgcttttggatcaaaagtatttttgcattcgtctgcggcaacctcaattaaaatagggacaacctcagacaaataatcgtcatgcttatcggtggttatccctatcattcgttttacttgttggatgtccattggatcaccctttcaattttgtaagcagagtttcacgcttcatgttgaaataaccgggtatctcctgctcttttgcttttctcttcagttcatcaagagtcattttgtcataatccatagttttcaaccgtcgcattctattaaaagaagccagacccatgaagaccggcccccttacagtttgtgtttaaatgcaaccatacgaatgtttttaggctcgtatacacgtttccagttagaaggatcggctaattcctcattcgttggtgcaagcccagcgacattgtttttcacgaaacgcacgccgcgtggatgtaaaaggaagtgttgacgattaatgagaatgtcttcaccttgcaagctgtcgcggtctacttcggtaggtgttggcgctgctccgttcccgaggccgattgctcccgcaccaaataaatatgaagtatatacttttccgccttcctcaagggtttcaacaggcatgctgtcatccacaataacccgcttttcttggtagaatggaatttttgcagccgcctctgaatccttcacaaattcaataaggttctgcttcttcatttccgcataagtattcgagtgaacgccgattgcagtcaatttattctcagcatcccccatcacatgtgttgcatcaatgaatgtttcaccattgaaaacaccatctgacaaagtagaaatatcaagaatattgtctttcatcgttggtgaagcgaacacaccttccagctctgctaaaagtgttgcttgtctgcgtcgtgcccaatagcttgccacaagcgcagcgatcgcggccattggatcactaccagccaatgattttgccaactcatttgctccccatgctttaccacgaagcaaaagcaccgcttcatcaaaatctgatgtgattttttcaggtgtaagaggtgttttgtcagataaaacttcgtcctctccctctaaatcatcccaaaaaggcatttgaatagtggtaccgcctgaagaggctaaacgatccaattccggattatttgagataatcccgctctgttgtaatgctgataattcggctgttctttgaattacatatgggttaaaaacctctggaacgataacgtccgctattttagttgttgccattgtcatttctcctttattttaaattaagctgatgttcccggatcgcctttttcaccttttggacctcgaggaccctccgggccttgtggtcctgtatctccttttggcccctgcggacctgctgggcctctatcacctttagggcctctttctcccgctggtagattcacattgcgaagaaaacgcggaatgcgttttttcatgccttcacacccccattactgtgcttctttttgcaaacgcatcgctaattctggattctctctaaaaaggcgcccttgctcagtcagattcaacgtttctttcttaaaagggtttgcaggcgtctgcgttccggattgaccggatacatgcggctgcctacctgctaaagatggagcgcctttttgatcttcctcaaaaagatagctatcgctttccctgagagccgttagctgttcgtcaagaccaatcactttgccgtcacctaatttcaaatcctcaagatttaaattggctttaacagccttgatgttttttgacttcgcatcacgtaatgctgattcaatcgcgaaatcaaaagcctgctgatctaatttttgctgatattcagcagcagtcttctggttttcttcttggagactttcaatcgccgcctgaagctcttcgttacctttagcctgcttctgcaaagtgttcaactgctggtcccgttcgtcaagctggcttttcaagtccttcttctcattgttgactgcatcaaaacgctccttcgggaaccattgaccgttactgacaatatcaatcttttgatctccggctttttcgatcacctgagcatataaatcgtcaccaagcaattcttttaaactcatttcattctctcctttgatgtttttttgcgtgtccacctcacgcacaggatttacgtttgtttttgctctaaacctttaaaacgagcagcatgcggcccctgaccgtttcaccctcttaaccgcttgttgcacccctcttctatgcaaccaccgcatatttacttgctatctatagatttgtaccactcttcataggtttggtatgggattgtctggcctgacccgctaccgccttccctcgcccttctcgtatccggcagagcgccgttcactttaaacgcaattgtacaacggcagtttatatcgtctttcgcattattcatgtgccccggagccggaccgacaccgccgtaaattgatttgaagagtccattgcgttctattgtcttcccgtccagcttcctgtgcccggctcgtgttttaagatcaagggtagcattccacattttttcaagattgctccgctttgaggctttctcagcgctttccattcttgccgatacttgtaccctatgagcttctgttctcgccacgtcacgggctttccggcgggcaaattcggttgctctttcaatgcggcgggcgatctttgaataatcctcccccgcttgtaggccctgtgcgacggaaatttgaatctgccggacataatcgtcgcgatgccgcctgtatatcgctgacaaagtcaattcagctatggggtttagaatggcctgccgaatgacttcggctgtcgggatgctaaaacccaagttaaccacggattccatttcaaatagataagcagaacgcatataattctctaaaaactgcttggctgctaatgcctcaacaatagttagaatggttttgaaagccttgtgagattcctcggccatcctctccatttccttgttcagacgattgtatttgttggcatcggctaaagtaagctggccgtccttactgtatttcgcatacagccgggcaatttgtgcattggtctcctttaagcgagatgcaaaaacgacatcaatcttttgagcatcctcagtgatcatgtcgtccaggtacttatcaatatcattctggttcatcttcatcaccgcccacgtctgtttccacatccgttaacggcggcatgctgttcctgtattcgatttcttcagattcaattcgcttcatttcagcttctacatcgtcaacccatggatgatgagcgagacgagtttctttgcttaaatcagtgctttgattacccatctgcacctcttcaagttcattggtcatacgtgaacggttgaatgtcatttgtaagagagtgtgatcgtattccccttggccggtcatccgcaaatattcagtaaaaaaccaaaagaaggcatgcaaagccggacggaatttcctctcagcttcatttgccttcagatcaagtaaagaatataggtttttaattgcaacgttcgtcggtgaatttcccactttgtcaggattattgttaactccctgcccgaaccggtatatattttcttcaagtcggtcaaggtgggtgttcgcgctgtcaatcggtacttcagcagttttcatatccattccgccatccgaaccgacttcaacggccttgtaataacgaagatttgtcatgaactcgctcaaatcttgaccgccaaaatttttaagaatgtatatgaagtcttgcatttcatcaaaagtatttgcgttgtttgaaatgttgctgttgtactgatcaattaaatccttgtaaaaaacaagatcgctgacgccttcttcattgttcttgaactcgattaagggtacttttccccacccatacccggcattccctaaataaaaatggctctccggattttgttcgtagtcaaaatcaaggacaagagcgccatcgtgcatgacgtagtagaatgtctgctcatccgtgtacaattcgaccttacgagtgtattcatcatcaatgtttttcacatcataatacctgattgcatacaggagcttccgctttttcgtggtatcgtataccgcaatgacctcttcagcaggaatccggataaaatcaaacttcccgtcttcatcaacaaacgggtggagccattcactgcctttattactggcgtttttcaaaagctcattcattacgtcatcaaaatcttcgtttacaaagtcattgaccaactccaagaactttgaatcttcagcattaaaagtgattggtttcccaaccaggtattgcactttctgttggaccagcagcttgtgccagttatgagaaatacggttattgggcttttccgtatctatttttcgtacgccattctcatagaaatagcgcagtcttttttttatgtcggcctgattcatgtaatatgcgacgccctcaagcattcggtcacgatctaattcgtgtttatcaatcatcttttgaataaccgtagtgtccggcagagtatctgatgtttctgcactgtcctgaatgattttcaacagctcttctgtgtgtgttggggttattggatacaatagaaatcagctcctttctttttatctcgtcatgacccgtacgcccggtcgcttcatatcccgttcaaaagcataacgggtagcatctatagtgtggttgtcagcgtcctcaagccgcgccttcggattaccgtctctgtcagtctgatagtcgatattctcgaattctcgggcgatattaggtgttctcaacggatcaataataatggcgtctaaatcatcaagccattcttcgccatattgaaccgagtcaggtccttttttcgcgcctgtaatgcgccggatgccatggtctattttcaattcatcaatacttttaggttcggcactgtcagcagtaatttcttgactctcatatccttttgacctgatccattttgccagctctctgttggaaaccttttgatcataaagctcatcaatcgcatagatactgttccgcttcttgtcatagtgccacctgacataagcgagaggatcaggaccatatccaaagtcaacgccctgccggatgttgtcgaaggagcgaaccatttcatcagtaatgcagccgttctcgattttcaaattatcaaacggcacaacaccactccctaacgcttcgccgagatattcccatctgtactttaatgggttccgttccttaacgatctcagcctcttccttaaaggcttttgagatataaggattttcgagatatgttgaatgatggatatatgtgttctttggtacgaatgaagattcatattttttgttaacccacgattgctttcttttcggcggattgtatgaatagtaaaaagcataaaaaagaccgtccgggagttcagcccgcaggacggaattttcgatcattgaaatttcttcttcaagtttaaattcggcaagctcttcgacccacaggaaggcaaccggaaattttgcgatcttgagtgatttgatttttgccggatcgtccgcacccctgaagatgatgctgtttcccctgggtttgtacgtgagcctcatcggcgatttattgacatgccagtattcacccacgcccagcagatcaattgactctttaagctgctcgaaaaccgattcccctaatgtgttggcgactttccgaaccacaagtgtactgaccgggtatttcatcatgtcgttgactattcgggtaccaatatgcgtcgatttcgaagagccgcggccaccctttaagacataccggaggtatttgtgactgttggctgccgcccagaacgatcggaattttggcgttacgatgtccgatattcgcttaaccttcgtcaacgtcttcacttcctatatcatcaatgatcgtcacgccgctgtcttttggagcgtctttctcgacttcgttccgtgttttctcgatattcaagcgcatttgttccagtttaaggcgccgctcatcttgctcatgcgccagctggtcaaattgcttgatcaagctccggagctcgcccattgcccgagattgagcgttcaggaatgttgcatgacgatcccaagcgaattgaaactcccattctcgctcatcgccaaacatacctggcttctcttttttcaaaactttggttacatcatcttgatcctgcacaaacataatgcgttgcgcccgtagaatggccgcgtattgaatctgaatctggtcccatatcatatcagcaggggaacgctcctgaatctcttccatgatttcaagcgtttcttccggcagatactttgagaagaacccatgtgttacagcgttttgatttcttgccggagccgccccgccgctatttcctaatgcgtttttgttgccgggttgcccgcctatttttgtgtgcacacttttttcaatgggtgcaccctttttcctttcccaaccatgccgctgcttccacgatttaatggtgttcaccgacaccccgtacttctcggcaaggtccttgtatttcatgcctttgacgtaatccttatacgcctgaatgtgcttttcagccatctacattcaccgccgcccccttctgattcgtgtttgttttggaaaagatattccctctaaaccgacgccgtactcagaccgttaaccaccaatagtttttctgagatttatcggaatcagtttacagagaacataaaaaagcatcctgaggaatgctttttagtagacactaatgttatctttaagaattttaaagtctttgtctattatttgttcaccaattgtttttaattctccatttattctagaatttttcacatcaatagaacgagtgactatttcaatgcctgtaataattcctattaacccatcacatatagcattatgtgcctcttgcaatacttcgggtggcttttcttttagcactttttttaataagttttggacttcttcagacgcccagtagtagctttccaataatttctcaagatctcttctatcggaggtaattaatatattggttttacctttaatagagcttaattcagttgtgatttcagcaatttttctctttaataaatgattagccaatgacagtattctcacctcaaccatattgaaaatgaaatttttccgaatgaaagaacctatcataaatagatgcagtcgttagaataaaaaagcaccccaagggatgcccatgttatttaatccaatctcttaattctttaattgtgttatatgttttagcccaaacattattttgctcaaggtattccataccgtcaaaagtaatttttgcatgttttaataatgtcatttttacagggttacccataccagctctaatgacagttgcattttcaattaaatttttacgttgcatcatttctacaacttcaccaaaaaactgaagatctgcatcgtaatcggtatatctaggctcaatacctttgtccatctcttttaaaatactataaactagttttctgcgatccatttactcacctcccaccttattatcggttaaggagtaggagaaaggaacaatccgcagaatttgtcgagcgaaagcgcccttcataaataggtggcaaccgtaagacgaaaaaagcacattggattactaatatctatatggtattttagatttattaactgagttttcatcaagatggtcataaccattcatttccaaaaatttcagtattccgtctttggctatatccatattattcttcggcccaattgttaaacctttaattgcacttttatcatggaatggtacagtaagataaggaataaaagtaccatttgaaactctgcaagaatagtctaaatagtccggttcaacagcctttggaattaatgctactctgtactcctcttcttgagaaaaacatgaatctttaaaaaagacagaaaaaattttcacatacaaagacaagaaaccattttgataactccattgcgaccattgataagggtcatctaatttgttttgaaaaaacaaataacctccaataaacttactcattagctcttcgatcattttcctttgtgttttttcatcataaacaactggaaattccaatagatcataattatctaaatttaactttccaaataaatttttagggtcaagaacaatattataaccatcattatttgtataattagaccaaagtaaatttgaatctgaatttgtagtgagtgacattacatagacaggtttttttaaaggtttagattcaataatatatttaaaatggtttaagaaactgtcttttgattcgccgcaaatatctgatattacctcttcacataaattataagtgtacaacagttcatttttatcgttcaaaaagtttgcatcagatagccaaaattctttacgttttaaaattccttctaccccatagatatttgtataatgatagagtaattttattttctttttctttttgctttctataaattcataaacgaaattgcgaaaatcctgatggggctgtattgtctttggtttaatatcttttaatttcaaaaccttaccctcccagtttattatcggtaaaaggataggaacctttgcaaaatttgtctaacgaaagaatcgttcggcttctgagattctaccggttacacccgattaccttaatgcttcagatgtcgttatgacttcttggcccataaactttctcaactcgtctatactctcaaaaataaacttagccatttcggaggtttctccattttagggttatattaattatagtcaataccaaccagatcattgccaaaatcatagtaataatatcgagagtgctgagatgaccataattaaaattagtgaacaatatcacaaacagaataaagaataagatcgttgaaccatcgattaattttttcatatttgctcatttccttctatgtttttgaaaatccaaaatatcctctttcagaaaaagcctgtcccgaggcatttctttcatcggctctaattccccgcttttaactaactggtttaggtattgacgagtgaagcccaatatttcaattgcttcgcttgtattaacggtttcctcatttaagaaccgtttaattgcatcgcgttctttaagattgtacataatatcatcctctttgaattccctaatttgtaacaataaacaataccattatacctataacaatagtagtctttaaaggattttttgaaaacttttcttatatttcaataaataaacaacctattcatgctaaacagaataggctgtgatctgctctatttttcattttcaggcgagaacgttcgatgttcttctgcacggttccttttttaatccccaataactgcgctatctcttcgaatgacatgttttgcacagcgtgcatcatgaaaatgtctttttctctttcagtaagtactgaaagagcatcagcgattctttccttatcccaatcacttacctctccctcagcttcttgaacgattgcgtattcttccgggaacgcatcaattaagcgcggatcagcaagaatcgtcctttgatatgcgtctcttctgtcagcgcctcggcgtgcgccgggctgtcttccgttctgcagccattcaagagtgaattcaatatcgctgatcatgctactgataatctttttgtcgtttatttgttcagccgtcagattaacttcagccgtatctttgtagagccggtacatttttcttgtttctcttaaagctcgtttgtattcaatgattaaatcctgcattctgattcctctcccttatttgcgcttaaatgcgccgcccttgcctcgtttaagtctttgcatgttcgtgttcatcatttgttgccagaaacgatctgagcgctcctgcgtgtttttattgggctttttctttttctgcttcatgtcatccctccgctcaaataaaaaacggacaccaatcagagcacagtgattatgtgcaatgatcagtgtccgcaggctttccgtcttggacttatttaatttgaattatcctcagttagagaactattaatgtctgaaagatttgaaatgttcaatgtgctaggatcaattcccattaaatgaaaagctaattgggcctgtactaatgaacgtaatttttcatcttgaattttatccgccaagtctattgattcttttctattagaattttctaatacactatcatggtattcctttacacgtatccgtagcttttgtgactcctttaagaacataagtgaaatcccttcaaaaattaaacttccaacaacactaattgcactactaacagtgttgtctgagccaacagcaaaaatgatgatacctattaaaaggataaaaccaactatagacataattagaccaacatagaattgcaaatttgaatgattagtagcttgttgttgatatatacccaatgttctttcatatggtttttcatgaagttttttataaggtttttcatagggtctttcataagatctttcatgagactttacttcttgttcttgtttcatcacatttttttgtgcttcttgttcttctttttcatcgagattcttagtatgttctttaagaaattcaaattccctcaatgtccttaagtatctctcttcatgttttctctttataagtgtaaaaactgtgactaaaaaaaaggtaaggccaaaaaatattgacatcagcgcagaaagagcttctggtgaatcaaatagagacaaaacatccttcaaaccatttcctcctgaaaccgattatttacaataaaccctattttatcatatcggcgttaatacgatttctattaatagttaccctttctcctctttcttttcatcccgtcaccccatcaatcccggcaggacagcgacagcgaagaagaaaagccccacgcatgccccgaccagccagatatttgttttatcccgtttagcgataatggtatggtcgccaatcatttttaaatcgtcagatcgagcgacaagcgtcgggatgttgtccgggtgaacctttaaaagctcggccgcctgctcgacggtcattgcttcgtccttcgtggccttcacgttccgctggagttctacttgtaatggcatcattccgcatcaccctccaattcgttttgggcaactgttatcgcgaaactcagattagtaatgatcttttctaatgcctgtttgtatcgttttctatccccgcttagatgctgaatgtccttttgtgcctgtcgaaattgatgaactgttacttcctgctgacgcttgttttcctcgatgatttcctgctgcttaacagtctgttcagcttgctcaataagccaagcaatttccttctgaggaatgtatgtcagttttttcagacgttcaattctttctttcatgcccgttcctcccccgcagggggaacccctgctatttgaatttatggccaatctcgtaatcacaacgagccaggccgccttttattgtttgaatgattgttttaccgtgttccgggacgtccattagatgagcagtcccttcagtgccatctaaaacgatgatgcggactttccccggctcgatgctttgctgaatagttgtttcctgattttttatttctgttggcttgttcactctggccgccccctgtgctatgatagaagtaccagttcatatcaaaggcactgaggcgcagcttcggtgcttttttacgttttacgacggcagccgcatcgttaatccggcagatggctttaattcctcacggtagatgattggatgcttttcgacgtatgccgccaactgctccggcgtcattttccactccttaactggaccagacttgtatggatcaattttttcttgcatgttgttgacctcctgattatttgatttaggatctctacaaaagctacctgtcatgacacaatctcagttataatgacttccacacgtggctcttcactgtaaaacttactgaccttcaaatcgactacctgactatcatccttgtatatcagatgatttaaagcgtctttgacaccttttacatagttatcgacgtccggctttgttacagggcgtaacagccctttctcagcgttctcctttttcctcttggatccggatacagctttcggcatcggtctgaatactctgacatccattgccacaggtcccgtaataacttgttttggccgatactgtgacgccaccagtgcaacatattgtttaaaattctttgatttcaaaggatcatgcattttaaccttgccatttataacagatcccctcggcctcccctgtgcaacaggctcgccgtaaactataaactgaatggaatccaaccgtcattacctcccgtcaatttgttcccagtgctgaatctgcttttccttgtacggcgctgtgaggataatggccggcagcaggataaccgctttaagcactgtgcatcagctccatttgtttgattttttcctcaagcacccggatcgccggggtaaggtcctggccggccgtttgctcggcgggcccgaacagatacataccgctggttgctgtgaagttcgctttttccgtcattcccaatctcctaacctatggtttaattgcatccggtcgcccttgatggtcactgtgtaatctctgcacatttgatgaatgcgggagcccagcgcctcgtcgatgtccaaaatttcgaccgtatcaagctcggaagagattagcagaggcttgtgattcaagtaccggtaattcacaaccgattgaatttgttccacttgccaatccgtcgcccgcggcccccccttcactggtttgaataagtcatcaatgaacaggacctcggctttccgcatggcgtcgagctttgtttccagctggtcaaagtcatttcgcagatcgcccattccctctacgtacgggaaatacatgcagtaaattgattttttcttgatcagattgttcatgatcgccgttaacagatgcgtttttccgctacccggctgcccgagcaaagcgatactgtttgaacgttttcccatgatgctgagaaaatccttatagtattccactgcgcactcataagcgtccttgatcatgtccggcttcccgttcttaatgaagtttccaaaaaggagcttttcgaattcctccgtgatgccgctggccttcataagccgggcgatctttttccgcttcacacactcgcattgcttggaaaatgtggttttccattcccgggccttatccggcaagcatactttcccagccaggtaatcctcttctctgaccatttgatcgggggccaggctctccattgtcatatgctcttttctcagctgacgctcggtgtcttggtgaatccggtaaacgataatgcccttatccttgcagtcagagcactcatattcagccttttcttctgaggcggcctgtcccgttgaagatgctgctgaccgatcccggagcttggttagaatggccttcattgccgcgtccatatcttgcgttttgcgagcttccatactgctgtttcccctttcgtctctggctaaatgggtttgagaggattgcttcaatgtaattcaaattgacgttgttgcccttgcttctgaaagcctgtttcattgcctccatgactttctcttcgccgtaatcatccaccatatacccgagccgctgaacctccatcgtgccaatggtacgggctgttttgttttcgaatagttcaaatgcttttttcattctttcgtcaacctcctgctgtcctaaaggtattggagccgggcctatcttcttgttataatttccaagctggatgtactcggcataattcaacaccgtcacaatgaaaccgcgtttttgcggcagccggtccagcttcaaatactcttgctttaccatccgatctaacgagtatttgatctgatcagaagaccagttgaaacgcttggctaaatctacaagcttaacgattgtctgcccaagctttagttcttgatctgccctgtactccgcccgtttgaataaataatcgtatattgtctcatcacgtgaatccttaaatggcagccgaggtaggaccacataccccaaaccttgcaaatccatgccgctcacctacttcctttcacacagtgctgtcagagccttgaaatctatttctactaatctcagagacggctcatttgtctttaagtagtcagtcgtgtaccgggtatacaagtcctttctcatgtggcgctgaaccgttttgaccagccagagataacaatgtgggatgggaatcctgatcaactccctttccatcagctcaccaactccgaaaaatggatgatgctgttcagttgattagtggcccggcaatacttgcatttttcgcatcgctccggcttctctccgccgtgtttcacttgcaaaatccgatccatccgctgctcaatctcttcaagctctacttccatcctgccttcatcaatattgatgacagctttatcaggtggatcttcttttgaaacccctacaatcaggggctcaagccattcgttacgcccagtcattcttttttcaagctcagcatacagtgccatttgtgcaatatagccatttgcctcgacgaatgagcaatagcctatttccggatgccaaaccctctcccggagtgaacgggctgttttcagatcggcaaaacggctgccggcagggttgtatacgtccagcttgcctttccatgaaacaccgaagagttcggccgttacgataacttcctttgctccttgcagaacgaacatacagagttcgtcatgttgaatcgcttcaatcatcagatcagctaactgatactgcttgtacagctggcccttttgtgtaaaaagtgatggagtgttctttttaaattcatcaaaagcctgttcaccctcaagccaggcatgaacgtattggccgaagaggagcgcctccgatgtaggcggtgtccattctccgttcagctttgccatcgcggcagcctcgcactgcaaaaagcttttatattgagaatttgacatgtagtatctatcaatctcgttagagtaataattctccttgttcagtgccggtatccgcattagcaggatcacccgccttttctttactatcagcaggcttgtcagcttgctctttctgctttttaaattcttcctcagcctttgatttagtcgcgccagtggccttcacattgaagtaatcctctttcttcgccatcccatctcgcagtgacgtgtaaatacggccaattttcaggaaatcttgctcagtaaaggcatcaacattacttccgatgtactcctgaatcatttccttagtgatgccaaactcttttttaaatagggagaaggcgcttctgagccggtcttccagtggttccttatgaccgctaatcaatgttttttgacacatatctaccgccgcatcaacgatgtctcccgggatcactccaagtatgcaggcgcgaacccggcgggctccttgattggcaaccatttcgtaaatatccctcggatcatcaagtttggtaatggagcccctcgccttccgttcatgcttcacagtgaaaattttggtttgccgggtattcgtttcaagatcccaagcgtaagccatgacagatgattcaccggccttttgttccaactccataattccgtaatcaatgttcccccaattctgagccaaggcctctgccagccggatagatggaccggagacctttgtgccgccacgaggatattcatacactgcattctcggccaaaagcctccgttcgcatgcttttttaatccggtcaaacgccgcgtatacgtcccgtgggaatttctttgcgatgaccattgccgcctgtacttcttgagcctgtcggcttaccatcgcttccgtagtcacgccagtagcctgctgaggcgctggcatgtaatctgagtaatctacctgtgataatccattcattgtgcttctgccacctttcttttgtaggcttccgttccaagacgctgccattctcggtatgcgtccattgacgggaaggaaaataccggtttgcctttactgaacatgatcgagccgccgacttgtctcagacgcttctgatcgtccgcccggtcactgaaagatgctgttattcgtttaaccatgtgtaaaacctccattgtcttttatgaggtaatttggtataataaaggaactaatctttaccaaaagaccttttgaagtccactctgccaagtgggctttttttattgctcatttttaaattcaaaaccaagatgctccttcagataccgctcaaggttttccctcaagatgacttctccttcagcactatctatcacgtaatcatcgaaagccgttacttcatccccaaagaaatctttttgcgtttccggctcagtcagcttgtcatgccagttgttcaagaccatcgggttttcaatattcatcgcgaacacctactcacaacactcaggtgaatcccgcgggctgccatatttaaaacggtttgatgtaagtgccctttattggccagcctattaatatcctctgcaataaccttgatgctccctgcaagactgatagcttcttcgtaatcgccatcccgtaacgcctccgaaagcaagatagagagctcttccgccgactcgattttcctttttgctaaatctgcatctgctttaagaaactgattgattttcataccagcaccgcctgcctttcttctgttttcgccattgcaacctgacacattagcgctttccgtgtccacctttcggccagttctttcatgttcagtccatgactacgggccagcgaatatatcagcgttttgtttgccgggatcagatcaaaaatctgcttaatatcggccatgggcagttcttcaggttgtcggcctggcctatcgtttgccagccagcgcgctaaatgccttgttgcttgcaatgcttcttcaagttggtgaaccatgttgattaccgctgcgcttgcgctctcattaagagctgggtctattggagccgccgttgtcgggtgcagccgaaaaagataatgtacgagatcaatatgttcataggcctcacacgcctcaaaccatctgatgcataattcgggggtcagcttactaaaaccattttcaacatcggaaacgtaacgttgatccttcccgcctatcaaactgccgatctgatattgtgtaaacccggccgctttacgaacacagcgcatgatcttcggtaaattccgcaagttgtacggattgttctccatatgtttgcctcctgatatattcagctgtttgctgttaaaatttaattagggtcaaaagatgttttattgtattggcttatgattttttcgaatatccggcctcatgtctctaaatttcgctttgtggccacaataaaaacgaacatttactctatagagcctctttcatgattgcttgttcttgagcttcgatccatgcatcaatattgtgtttggtaaagaaaatccgatttcgcacacgaaagtgaggaatttgtttttctcgaaccattgtgtaaattgtgtcatggtgaacacccaggtaatcagcagtttcttgaacagttaatgtgttacgtatcataatcggcctcctaagcaacgcgtcatttactcgtttcgtgtaacttttgatcaaaaaaaatctcatcgacatctttattcaacaacttggatatttgatgtgctttttcaagacttggctttgtacgacccatttctatattcgcataaccgcttacagatctgtagccgagctttttagacataaaggtttgggtctttccttgagaaattctggtcgcccgtaatttttctaacactattaactcaccaccttactctttttgtgtaactcgttaaacccataataatatacacaataagggtaagtcaatatatttttattctttttgtgtaagttattatctgttgtgtgtaaaccatgttaaaatttacacaccaaatgaaaaaaggtgtataataatggataatataacagggaaaattctaactgaattaagagaaaaaaaaggttggagcaaatcttttgtcgcaaaaaaattgggtataaaaacaatgtctacatatgcgaattgggagtacggtttaaggaaaccggatggcgagatgcttgtgagaattgcaaccctgtatggtgtaactactgactatctcctaactggaaaagaacctaatcaatttaatactgaccttttcgatgattctgatttacaactcgcctttagagaagctcgtgatttctcagaagaaagtcaaaaacaggcaattgattttataaagtaccttaaagagaaagaagaacgcgaaggccgaaagcctaaaaagtaacatactggcgaaacccttatttatattatttattatgttatttctgtttactaataagatctgaattctcttccggattggtcctgaatcccttctggaaagttaatatttacaagcccttccccccttataaaacaaaggtttcagcatttaatcccttccggattctcttccgaactgattcggaattctcttcggaaaaaatcaggataaatccgagtgttaaactcgattacataaagaaatcatcattaattaaaggggcatgcaaattggcttttacatttaaaaatgaagaagtttataacagtgtagctaaaaagaaacgaaaggcaacagggacatttagaaaaacatactatgctgcacaaacattgctaggacaaaaaaatcaagtaatgattgaagttattttcggatttttgactggtccacaggtcagtagtcaaggattaattatcgcaacaaaagaaaatttacatcttgtaactgataaagctggaggtcacaaaataataagttggaattatgaagaaattataagtatttcagttctaaagcatacttttactggttttacacttgaatttaaaacagttgatggtgattacctaattaaaagtatcatggaaggtgatcatgaaaaacttataaattatgttaggaagtcggttgtcacagcaaacaaaaaaacatccgctgaaaacacttctaaacgtaaagtcgaagaaaacccaataaattctgattttgattttgttgcttcagagatcagaaaatatgcaaccttgaaagatgaagggcttattaccgaggaagagtttacagcgaaaaaaaagaaacttttgaatatataaagtccgaattttcgggctagtgtcatcactcagaagaatatgaagttatctgtaacaagggcggttgataaaggtgcttgagcaaaatattaagttatatgttgaatcttatttatcccaatataatcaaataattgatagtctatataggacagcctactcaacaaatccagaagcctttcgtttaaaagatagatccaacataaaaatttatttgataaagttatcttcacttctagggagcaacaataccttacaactctatttaaccttcgaaaagaacaaaaatcttgaattagaaatagttgatctaacaaataaagaactttacgaagattattcaagctttagctcacttaaaaaatttatatttgataaatcaggagaaaaagatgggttaaaagaaaataatattatatatagcgacaatatctctttttacaaaaaatcattatatgaagagaaagatgatttcgtttctaccctagactccaaagagtggcaggaaactataaatgcgcaaatgcatatgttagcatctgaagaaggtaaaagttttattaaacacgttaatcaccctgtaagttactatgcaaaaaatgctgctaggtattcttattctcttcttgatttaaaggcgattatagatacagtaaatgacgaggattttagttatcaaatggaccaagctatcgcggcttacgaaaattctttatacctggcctcttgcgctactttaggtgtatgtctggaaacgttgtgtaaattgttactgaaagaaaatggtgtaaaggtaaaagatagtgatggcactatgttagacagactcggcgagcgtttaagagaacagaaaatcatcagctacaaattcaaaagccgcatagatgtatgctataaagtaagaaacttatcttcacatacaagtccaggcaaagtgttgcaaggagattgtcattttattattgctactataaacgaaattgttgatacctatttcaaatgagaaagtccgttcagggcttttctttcacaccaaaaacagaacatatattcccttcatggtggtgtttttaatgtcaatccagttatcgtatcttgaagaagaagtgaaaaaaatctattacaaattaaatattgagactcctgaagacattgatttagaaaggattgccgcggcatttcgtatctggctgcattatgagcaaagagaaagctgcatgtttcaaattaacggtgagtatagcgttgtccttgatgctcgtgcctctccacaagaacaatggcaagactttgttcatgagctatgccatgtcttaaaacataccggaaaccaatttcacatgaatagaatgttcaggcagcttcaggaataccaggcgaacagtttcatgtatcacttctgcgtaccaacgttcatgctcataaaattgaaactgccccgtcttaaatcagaggccattaaattaataggagatacatttaatgtgacatattccttggccgctaaacggatagaaatattcaacagaaaacagttttcaattctctggcataaaaatcttcatcaaataagtaaattgaatgttaggaggtagccaaatggccagtatagagccccgtggaaaaaactcttttagattaattgttgagaatggttacgatgccaaaggtaaaagggatagaagaaagaaaacaattcgtatagaagatccaaagctattaaagactaaacggaaattacaagagtatcttgaggaccagctgcaccgtttcagaattgaagtagaggccggcgagtatattgctccggaaaaatccacttttgattcatttgcagaaaaatggattgaaaagaaactctttaataagaatggtaagccttactcttttacaacatctgttaaatattcaaatcacttaaaaaatcacattcttccagcattaggtcataaaaaaatagacaaaataaaaagccttcatattgttgattttatagatgatttatctaaagatggggctagaaaagatggaaagcctggcggattaggtgatcaaacaatcaaagatatttttaaaatcttacaagcattatttaaaactgccacagaggaatggaaattgataaaagacgatcctattgagggattgagttcgccagaagctgagaataaagaaatgaactttcttgaatctgacgaagcagctgaatgtattaaagtgttgtatgaaatagatattaaatggcgcttatattatcttgcagctctgatcggggggcttcgtagaggggaagctcttgcctgtgaatggcacttggatgtagattgggacaaaggtggaatatacgtaaatagatcaatttctaaaacaattaacggagagcctcatgtcaaaagcccaaagtcaaaaagttctcaacgattcgtcaaaatgcctgatttttatatgaatgagctggctaaatattatcgcttatggaaaaaagaaaaattattgcttggcgatgcctgggaaggcggagaacatcaatatgtgtttcacagtggtaaaggaaaaccttactactatacaacccctaccgcaaaatggactaaaatcaaaaagaagtacggtctaaaagatgttcgtcttcatgacttgcggcatactatggtggctctccttatggaagctggcgaaagtctcagtgctattcaacgaagagctggacatgccagtgctcgaacaactagtgatatttatggtcatgttaccgagaaactcgaaaatagcacagtaaaacactttaaccagttcgatcctagaaacctagcacaaaaacagagttaattttgaaattcctcttcaaaatcagctcaaaaaaaataatttcgtccccaattcgtccccaactcgatgaatgatgacaaaatcaataaataagcaaagtaaaaaacccttgctacgcaagggttttggctatgattccgactgggctcgaaccagcgacctctaccctgtcaaggtagcgctctcccagctgagctacggaatcatgatatgtatgtgttgctgggtatgttgttgtctctctgacatttataattatatatcctgatttctcattcgtcaacactttttttatctaaaataaaaaaagggcgcgtcgcaaaattgacggcgcccttttcgtttatgatctcacttgggcaggggttatttttttcaatgcctgttcgaagtcccgctctaaatcttcggcgttttcgactccgacgctcaagcgcagaaggccgtctgtgatgccgcgtttctccctctctgctttcggcatggcggcatgcgacatggctgcagggtatgagagaatggattcgacggcgccgaggctgacggcaaataccggaagcgatacgttttcgaccagctttttgacggcttctttgctttccaattcaaaggacaggacggcgcccgctccgctcgcttgccgtttatgggtatcggctcccgggtgtccggcaaggccgggatagtaaacgtttttgatggcgggatgtccgtcaaaataggcagccagccgctcagccgtccggctcgctttttccagtctgacctgcaatgtttttaagcctctcaatacgagccagcagtcctgaacgccgagcaccgctccaaatgaattttgcagcttatacagctgattgccgagctcttcatcttttacggcggcaaggcctgacagcacgtcgctgtggccgcttaaaaatttcgtcgcactgtgaagcacgatatctacgccgagatcaagcggacgctgcagagcaggcgtcataaaagtattgtcaaggtatgtcagacagccgtgatcctttgccagtttgacgacgcccttaatatccgtgatgccgagcgtcgggtttgacggtgtttccatatagatggctttcgtattcggccggatggcgcgggcgaccgcttctgtgtccgtcatatcgacaaaggtatgttcgatcccgaaacgggacagaacctcagtcaccatgcggaatgttccgccgtacacatcctccgtgacgaggacatggtcgccttgggataagagcagaaatgccgtcgaaatcgccgccattcccgagctgaaagcaaagcctctcgttccgccttcaagacctgcgatcgtttcttcaagcgctgttcttgtcggtgtgcctgagcggctgtagtcatatgtcccgaattcttcaaatgaagactgatggaatgtggaagcatgctgaatcgggacgctgacggctccggtggctccgtctgttttaaatggattgtgcacgagctgggtttccagcgtccaattgtgattactcatatgacacggccccctcttttacttgctgtaatgcctgctttacatcccgcttcaaatcttctgcatgttcaatgcccactgaaaatctcagcagacggttgcagacgccgtttgcgatacggatgtcttctggaatatccatgtgcgtctgtgtcgcggggtatgtaataaagctttccaccccgccgagactttctgcgaaacagatcgttttcagcgcctttaaaaacggattaacccattcctctttttgcagccggaaagacagcatcccgccttttccaggatataacacgtcggcgatttcttcttcctgttctaaaaattctgcaagttcacgggcgttttcttcatgacggcgcattctgagtccgagtgttttcatccctctcattaaaagccacgaatcaaacggcgggagaacggcgccgatcgcattttggtgattaaacatgatctcgccgagctcttcatcctttacgacagcaagaccggcaaggagatcattgtgccccgctaaatattttgtggcgctgtgaatgacgatatcagctcccagttcaagcggacgctggagcaccggggtataaaacgtattatccacaatcaaaagcaggccggcttctttcgtaatccgggcgattttttcaatgtccgcctcctgcattaacgggtttgtcggcgtttcaacaaataccgctttcgtgttttccgttattttggagcgtaaacagtcttcatcgctgaaatcatcgtaaataaagcttaagccgtattttctccattcgttttcaaacaaacggtacgtgcctccgtataaatcggaggatacaatcaattcatccccgcttttaaataaagccataatcgtttgaatggctgccattcccgagctgaaggcaaagcctctcgcaccgttttccaacacggcgatagcgtcttcaacgagctggcgtgtcgggtttttcgtgcgcacgtagtcaaaacctgtagattctcctattcctctatggcggtaagcggtggacagataaatcggcggactgaccgttcccgttgcttcttcgcttctatttccgatttgggctaattttgtatcaacatgctgcatcatcagtaagcaccatcctttttcaaaaataaaaaagccccctcttcataagaagaaggagcttttctcttcctcttatcttccaagcatgtgaatcgcttgctggatttagcaccttggcactttgccttcccgcggcaaagcaaaccggttgctgaggtttcaaagggccagtccctccacctctcgtgataagaatattgttttgtattttctgattgttctatattaacgcactataaaatgaatttcaataactttttatttatctgaactctcgcaagaagtgcatctgaagaaagaaatttctaataattcatggtacaataggaaaaaaccatcaagacaagaagcggcctggaggaatgcgaagtggcatcaaaaaacggaatcattcatgagaaaaaacttttctcccatgagcttgaagaggaaatgaccgttttggtctacctgcccgccaccttctcccccctgtataaatatcatacggtcatcgctcaggacggccatgattatttcagattagggagaatcgggcggcaggcggaagagcttatgtcaaaaggggaaattgaccgctgcatcattatcggcgtcccttataaaaatgtgcgggagcgaagaaacacataccatccagaagggtctaagttcgcctcatataagcgattcatcgcaaatgagctcgttccttttatcgacaaagaatacccgacttatcaagtcggatacggccgcaccatgatcggggattccctcggcggaaccgtttcgcttatgacggcgattgactatccgaacatgtttggaaacgtcatcatgcagtctccgtatgttgacgggcacgtgctggatgccgtccggcagtcggaggatctcaaacagatttccgtttatcatcaaatcggagaaaaagaaaccggcgttcacacgacagacggccaggttcttgatttcaccgcgccgaacgaagagctcaaacagctgctggaaagcaaacagtctgaatacacgtatgaaaccttcgacggggatcataaatggacctactggcagccgctcatcacgccggcgctgaaaaaaatgctgtaaccattcatttaaggagggaactttcatgaaatacggtattgttttatttccatcaaaaaaattacaggatctcgcaaattcgtaccggaaacgctacgacccgagctacgcgctcattcctccgcacctgacgctaagagatccgtttgaagcgacagaacaggaaatcgagcaggtcgtatcacagctgagacagacggcgaaagagtcgcatccgctcgttctgaaaatcacaaaatacagctcgttttctcctgtgaataatgtgatatatatgaaagcagagccgacggaggaattaaaatctctgagtgagaaatgctactcaggagcattatccggcgagccggaatacagcttcgttccgcatgtcacggtcggccagaagctgtcgtcagatgaacattccgacgtactcggacagctgaaaatgctggacatttcccacgaagaagtcatcgaccgttttcacttgctctatcagctggataacggctcatggactgtgtatgaaacatttttattaggcggaggagaataactgcttggaatccatcatcgcaaaaactgaaaaacagctaaacgacgcttttttcgtcagaaaagaggtctttgttaaagaacagcacgttccggaagaagaagagattgatcaattcgaagacacgtcagagcatatagtcatatatgacggcggccagccggtcggagccggcagatggcgcttgaaagacgggcatggaaaattagagcgcatctgcgtgatgaaaagccatcgttctttaggcgtcggagccatcattatgcaggcgcttgaaaaagcggcggcagccaaaggcgccgacagctttatcttacatgcgcagacgcaggcggttccgttttacgaaaaacaaggataccgcgtcacatccggcgaagaatttctcgatgcgggcatcccccatctggaaatgataaaggaacacaaacgataaaatcaaaagcactcctgttatatggcaggagtgcttttttatgaaaataaaactatttcatgaattttattgaattttatggaagatcaatgtatgtttagtatacgaagtattacaattcatacaaaaaatacaattcatatttcggagggataaacatgacggcaccaaaaggaaaacacatattcgggactgttaaagtgggcacaaaaggacagattgtcattcctaaagaagcaagagatgttttcgatataaatccgggggattcactgcttatgcttggggatgaccagcaaggtatcgcacttgttaaacaagaactctttttcgagtttgcaaaagatattttaaacgctaagcaaatcgacgcagatagcgaggatgagtaaatgcacgcgattgagctgaagcaattaacgaaacattataaagaaaccgccgccgttgaccgtcttgagttctcagttgagaaaggggaattttttgctttactcggtgagaacggagccggaaaaacgacattaatcagtatgctttgcggactcctttctccggatgacggtgatgcatcagtgcttggacacagtattttgactgatttagataaaataaaaccgaaattgaatatgtccccgcaggaaacagctatcgctcctcatctaaccgtacgggaaaacttagagtttatagccggtgtctacggaattccgaaaaaagaagcaaaaaaaagaacagatgagatgctcgaattgtttcaattaaaagagaaagaaagagcaaaaaccaaaacattatcaggaggaatgcagcgccgcctcagcatcgcaatgggaatgatcaccaagccggatatttatttcttagatgagccgacattagggctggacgtccgttcgcgccgcgagttgtggaaaaatcttgaggcattaaagggtgacatgacgattattttaacgacacactatttagaagaggctgaagccctggcagatcgtatttgcattttagaaaatgggactttaaaagcactgggcacggcggaggatctgaaaaagcaaactcattcagctacatttgaagatgcctttttagcgatttgtgacggggaggcgggtctttatgcttgatttcgccattcgcaaccgcaaagaaatttttcgtgaccccctgtctattatccttggaatcgccctgcctgttattctattgtttctgtttacggcgattgaaaaaaatgcgccgcttgatacctttaaaattcagcatttagcacccggactcattgttttcggttttgctttccttacgatgttctctgcattgctgatcgcaaaagacaaacagaccgcccttttgacccgtttgtttgcttcccctttaaaaacagccgattatgtcatcggttatgcaataccgatgctgccgttagccattttacaaatcgtcatttgttttatcgctgctgctgctgccggtttatccgccgagtggatgaatcttctcgcaggtatcgctgtcttgctgccgattgcgatgatgtccgttttcttcggtttatgtttaggggctgtgtttacggacaaacaaatttcaggtatcggaacgatttatattacactcgtgcaatttctgggcggggcttggatggaggtgagcctgctcggtgacacattcaaacatatcgcttatgccttaccgtttattcactcgatcgagctggcccaggaagtcataaccggagattattcttcctttcatcagcatatttggccgatagcgggatataccgttttggcgcttgcacttgctttcctcagttttatgaaaatcaggaagagataaaaaaagccggcactccgtaatgggagcgccggtcttctttattacgtttctttcagaaggtttattgtatgcggcagcagacgatcatcccccggactgccatggcccggaacgacaatgctgatgtcctgataccttttcatgactttgcggacggcgcgcggccacttatccggataaaagcccggagtaggcacgatttcctttgtttctaaagccttgattaagcaaccgccgaataagagcttatcctcaggcagccagacggtcatattgtcttccgtatgcccttttcccggataaaacgtttcaattttcatatcgccaaactgcagctttgtcacgtttttcaaatctccgagcggccggtcatatccctgctctcgggcgaagtcggcggtcagcttcgtgctgtgcacctttacgccgtatttgtacagggtgttcagcccgccgatacgatcatcatgggcgtgtgtcacaatggcatcggtcatccttttgccgggaaaccgcttttttatttgtgtcattaattgctctgtgagactgtcattccacggagtatcaatcagtacgattcctttggaagtctcaagaagcaatccgttcgcagggacgggacttccgtctgccgtaccggtgcttgtatgcatccaaacatgcggcgccagctgtgtgagagtgacaccttttgctgcggagccctccgcagcgtctgccggtttcattccggcagtaaagaggccgaatagaaataaccccgcaattaataatgaaagctttctcaaattgaatcattcctttccgcatctttcatatatacgactcaaaaaagcccggatatatccgggctttttcacacgtattgatttatcaaccggccttttcccatgatttgcggcagacgggaaagagagcgcttacgtttttcctcatgtactttcttttctgcggctgcggtgttttcctggcggcgctccacctctctgtacaccctgtcattggcaagggcggccgctttcgtaatgccggcataatcagacttataacccgctgcccggtttgcgtattgagaatactgctggttttgaatccgtcctgcataaatcatatgtacccctccccttcgctttcatttcccttaatcttactttttgaaacgctgttcttttgttatgatattctttgtctatcaaatggatgaacaccttttaatgggaggacccctttttgaaatgcgcccgactgaataaccgaacgatacatttacatacatattctagagaacattaccaattcctttttgaagaagctcagaaaggaaatattttttgcgcacattgtgagcagcccgtcttgatgaggctttcgattttagagcagcccgcattttatcaccggcaaaagggagacttcaccgcctgtgaaaaagcatgcgcggccgaggaaccacaagcggagaaagaaaaagaagagtataaggaagccggcatgttccgcctgccgaaaggaaaagcgatttcagagaatccgaaaccgatcgtctcagaatggaaaagcccgaaaaaagtgcctgcggccgaaccgttttcaccaacatccgaggcggctgatacatctttgttccccggcatcggcctgaaccgtgaacagatgaaggcagttactgaaacggacgggcctttattagtgcttgccggagcgggaagcggaaaaacaagggtgctgacagcacgcgccgcccatatgattgaacacctcggcatttcacctgagaatatgctgcttgtgacctttacgacaaaagccgtcgccgaaatgaaagagcggatggcaaatgagtacggtctggcagccggaaaagtctcccgtctcgtgaccggaacattccacagttttttctataaaatactctgtcattatgattcttcaaaatggaacggcagccagcttttaaaaatggagtggcaaaaagagcaatatgtgaaaaaggcgctctatgaagaaaacttggatgaaaaagagtttcccgtcgaccaggcgcttcagcttatcggctgctggaaaaacacgtatctcccccatgagaccattccgcttgcggacgactgggagaaaaaagtgtacaggctctacgaacattacgaacggcagaagcaggaaaaacggcaatttgattttgatgacatggcccaaggctgttatgaactgtttcaaagccggcctgatattctcgcgcagtaccaaaacagattttctcatattttgattgatgaatttcaagatatcaatcctgtccagtacaacattatgcaaatgatcgcaagcccagagaataacctgtgctgcgtgggtgatgacgaccaatccatttatgcgttccgcggcagcagcccgtctttcattttagattttcagaaagattatccggcagcaaagaccatttacttaacggcaaattaccgatcgccgcatccgatcgtctcaagcgctcatgccgtcgtaaagaaaaataaaaaacggtatgaaaaaacactttctgccgtcaaagacggcgttcacaatcccgtgatgttttatccttacgatgaagaagaagaagcgaccatgattgtttcggatatgaaagagaagattcaaaacggggcgagtcctgacgattttgccgtactttaccggacaaacagcgccggacgggccatttatgaaagactgcatcaatcatcgattccttatcatgccgacaggggcgtgcagacgttctacagccgcagaatcgtacgccagatcctcgcctacttatatgcgagtcagaatgaagatgatccggatgcggtgaaagacctgctgcccgccttatttttaaagcaatccgccctgcaaacgttaaaggcgctgtcaattactgaagattgcacgatgattaaggcactgacgaaactgcctgacctgaagccttttcaaatagggaagatcaagcagatcgttccgtttttcgcaagcatccggacaatgaagccgattgaagccatcacctttgcagaaagcaaaatgggtttttccgagtatttaaaaaaacggggcaatgagggaaacaaactggaaaaaggctctgatgatctcagggatgtcaaagtggccgccaaaaaattcaaaaccattcccgattttcttgcgcatgtcgatcatatgcgcgccgctgagaatctgaaaaccgatgaaaacggcgtcgaactgctgaccattcaccgctctaaaggtcttgaattcaatacggtctatattttaggcgcggctgacggctcgatcccccatgacttcgcacttgagacggcgagacagggcgatcccgctccgctcgaagaagaaagacggcttctgtatgtcgcaatgacaagggccatgcagcatttatatgtatcttgtcccgcgtacaggcggggaaaaacagcgcgcagctcaagatttctcgagccccttcttcggacggacagacggagcgcactcaggatataaagaacccggcagatcactgccgggttcttctcacataaaaaggcctttttagcaaggccggctgacgcctatttattgttcagcattttagaaatggtgccaaaatcaagtttctctttaccgcttgtaatagattgaacgattttgtcttccaattctttcggaacacgcttgttagccagctgggacaccttctgaatgacgcctctcaccgtgttttcatctttgaaattggcattttgcaatgatcctgcaaggttcatgacatccttcatgctgacgcctgttttcttctcaatatttttgaaaaattgattatccatggtgtgcctccttttgtggagtaatacgatattgtatgaataaagagcggaacatgtgcccgtaagacaaggaaaaaattccgagtgccccgtctctatactcctttatacatcagggaagcacgggactgaacggtcccgcgcttatccaaggtcttgctaaggtttagccaaaaaaggatgcaccgacaatgatcagaaggatgaacaatacgacaacaagaacaaatgttgagccgtatccgcctccgacatagccgcctccgtatccgccgcagccgccataaccgccgtagccgccgccgaatccgccatatccgaatcccatatttaagcacctcctttactctgtatactctatgtgagccgacttgtttggcttggataaatgcatagggccggtgcggatttcatttcattttattgagaatgctcatttttcttcagttttgcttctgtctcggcggcaaacacatctatccattcctcaaagcgcgatcccgcttcatcaaactcagacagctgtttttcaatagataagatatatttgtcatgctccagctggttttgattgtgccggcggtatttaccgtttatgaatgattcaaatatattcataacatcccctcctcctatgatctatgccgaacagaggccggcgttcggcaaaaaacaaaaaaaccggaagctccggttttttagaaaacggctatttcggttttttcttttggccgcagccgcagccttttttcttaatttttttttcgtaaggctgatgcacagttgatttgtatggagagtgttgggaaggtttgcttgattgattcatggtgatccttcctttccttatgtcatatatgccagtttatgccgaaagtgacggtaagttgctggtggaaccgccttattcctgcagaagacgagaaaccgcagcttcaatgattccggccgcgccggctatggctaacagcaaaatcagccattgcgcagccccgggtatcacaatctgcgccgcaattaaaaaggcggcacaccacacgcccgtacaccagtagcagctgagaagttcaccgataaatgccctgatgccttttccttttatgacaatgtaggtttctgtcgtgccgtctggtgcggtttctgttttttcctcgtgaaaaaggctccgaagcggcgccataatggtgtcaaatacgaaaagcctggccagccggaaaacggcaaacgataacagaataaatgaaagccaattgataaccacctgttcactccttttcaaaacttgacctctttatacatatgcgaaaaccctgatcttcatgaatcgcaccttgtccggtaaaaaaataggtgcggtttagttgtttttcttattccgctcggcgtttcatttgcattatataaagtatgaatgagaaaggagtgaaggttatgtcgtttgaagaaaaagtcgaaacactgcaaccgcaaatatacgaacaattatccaacgaattcgagcagacgatcgaagtgattgattgcgaaaatgtcacaatagatacaacacatataacggccgctctttctatacaagcctcagttactacggcgattatcctcgcgacacagctcgcgatcgcagatgaagacacagccgaccaaatagcaaccgaactgctgatcctggatgattgccaaataaaaaagaggaccgtcattcaagtcctgaacagccgcaatattaaaatcacactgactgcagacgatattatggcctttgtacaaattttgtttcaattattaaatatactttttgctgaactagacatcctttaacctttcttttcaaatatttaaatagaggtgagaacaaatggcagataacgaaaaattaaaaaaagaactcgaaaatctaccagaagtggatccgcttttaaaggtgcttgtcagcaatgtcttcaaaaaacacggcgtgacaaaagataaaatgcgggaaatacctgatgaagaaaaagaaatgctgatcgcattagtcaaagacatgcaggcaaaaacagaagcttttcttgaaagccagaaacagaaaaaagagcaggaaaaagcgcaagatcagcagaccaatccgcaaacccgcagagaacaattaatcgaacagctccggcaaagacgccaaaatcccggtcaataactaaaaaatagtgatttttatcaggatagatgcctgagtcaaagtaaggggccggctcatttaatattagtaaaagaaaaggaggaatagatatggaaagcagaccatactcttgggttgcacttgatcctgaatgcgaacatccgcgagaagaaaaagaagaaaaagaaggcagaagatgcagtgtttgctgtaacggaaacggattcggcgaagataatgccttccttgaccaagaccttgctcaagcgaatctcaacaaacaagtttctgaagaagcgattattatcagagactcttgtgatattaacgtaacgtcaacagacgttcaagcagtcgcttcagtcatgacagcgattaatgcagcagtcgtaacggccactctcacttcaatcgctgacggagtcatcgctgaattggtcgcacaagacttattgcagctaacagctaacaaacaaatcaaccgtcaaaaactgctcatcgaaaactcccgcggcgtaaacgtgacaacagtagatgccgatatcgcagtattgatctcaacagcgacaaatttactgattgctgtcttagtcatcacccttgtcctctaaaaagaaaaagcagagctaaaaatgctctgctttttcttattttctccgcatatgatgaatatatagacgttcacccacaccaagtgaggctcgcgtacatatgttgttaaagacaaaagtcaaataccctaaaagaaggagctgaaatccatgagctgcggaaaacaccatggccgagatgaaagttgtgtatgcgatgcagtcgagaagattttagcagaacaagaggctgttgaagaacaatgcccgactggatgctatacgaatcttttgagcccgacgattgcaggtaaagacaccattccgtttctcgtatttgataaaaaaggcggattgttctccacattcgggaacgtcggaggatttgcggatgacagccagtgctttgagtccattttctttcgtgtagaaagactatgcgattgctgcgcaacgctttcagtattgcgccccgtagatgtgcacggcgacaccctcagcgtctgccatccttgtgatcctgatttcttcggtttagaaaaaacagaattttgcattgaagttgatctgagctgcttcagcgccattcagtgcctttcacccgagcttgttaaccggcctgcgccgcacaaagagaaaaagcatcacggatagtcattgattcgcatctttcctaaagaagaatccccttccaaccttctattacagatgcaatcatcagcccgcccggacttccgggcggctgactctccgctatcgtttaaaccggtaccatttaaaacgtgaagtcaggagggatattatgagcaagcatacaacatactgtgtgcgtgaagcggtagaaaatattgaagacctgcaaaatgcggttgaagaagattgcccgacaggctgttattctaaacttttatctccggcttatacattaggcgatacagtgccgttcgccatcttcacctcaaaatcgaaaccgttcaccgcattcggaaacgtcggcgagctggataacggtccgtgctttaataccgtttttttcagagttgaaagggtctgtgacggctgtgccacattaagcctgcttattgcttttgacgagcataagcacattcttgattttacagataaagactctctctgcgatgtattccgtttagaaaaaacgaactattgcgttgaagtcgatctccatagcttctgcgccatcaattgcctgaacccgagactgatcaaccgcacacattcttaaatcaaaaagcataaaaataagctgccggatgaaagaattcaggcagctttttgtatggttaaaatccaagcggatgcagcgaggtaatatcgtctattgcgagttctgccggcgctccgttgcttgtcgtccgcaggaagatcgcattattttttctgccgacgattacgcctctgtaggtttttccgttggcttctatcagacaaagggtccgcggcatattatgcggcagcttcgttaagaaatcaattttttcaagaatggacattctgctcatcggctttttcacgcgctttggcggaaccttttcctctggggcggcattgtgaaccgcttcaggctctttttcagcggcatcaggctcttttttagcggcgtcgggcttggcagtgtcctgctccgcttgcgccggaacttcttgaacggcttcttctgcgcggctgtgctgttcaggtacttgcttttctggttcgacagccactgctccttcaggctgagtttgacattcttcctcccgctttccatgcatcggctcttcttccggcggctgaggcgctttcctttttttgattaatatgtcctgcattgatgattgcgtgtctgaataatccgcctgaacaatatacatgagcggttttttttccgcgtttctgttttgttttgacatcttcatccctccgattctgtcatgttttatttatatgacggaatgattaaaatcagaagaaagaaaaaagcaatccctgaaagggactgcttgttatttaacgtgcggtaatatggaatcctgaatcaacgtgaagattttcgcccgtgatgcctcttgacaggtcactgaacaagaatgcagccgtgtcgcccacttcttcaggtgttgtcgtgcggcgcagaggcgcgcgctcttcaatttctttcaggatggagttgaaatcactgattccttttgcagacagcgtacggatcggtcctgctgaaatgctgttgacgcggatgttttcttttcctaagtcagcggctaaatatctgacgctcgcatccagagacgcttttgccacacccattacgttatagtttgaaacgacgcgctctccgccgaggtaagtgagtgtaacgatgcttccgccttcagtcataatcggacgcgccgcttttgcgaccgctgtcagagagtaagaactgatgttatgcgcaagcaggaatccttcgcggttcgtatttaaatattcgccgacaagctcttctttgtttgcgaacgcgatgcagtgcgcgatgccgtgaatcacgccgacctgctctttaatgctcgcaaagcaagtttcgatctcagcgtcatttgtcacatcacacggaaggatgatggaatcatttctttctaatgtagccgcaaggtcatgaactgatttttccaagcgctctcccgcgtaagtgaaaatgaggcgcgctccggcttcatgcagcgaacgggcgattccccatgcgatactgcgtttattggcaacgcccatcacaacgatgttgcggccttcaagtgagaaattcatatgtataaagcctcctgtaatcgtcttaaagacatagttttagtacctgatcttaatttttatcatatcataaccttgtccagattgaaagcatgggaaaaagaccgcggatgttgaagcggtctcttttttatctcgtctgcagactgttccttttaaaggcaaaatgattggtcgggccgtgtccctctccaatgccaagcgtatgttccacggcttcccgcacaaaattgacggctgtctcaaacgcggtctgaatggttttcccctttgccgtttccgccgtcagcgcggctgcgaacgtgcaacctgttccgtgggtgtgtttggtgtcaatataagcgtggctgatttgggtaaaagacgaaccgtcaaataataaatcaacgatcctcccctgttcaggctggtgtccgccttttatgatgacatgctttgcaccaagcttgcaaaggcgttcggccgcttttttccggtcctcaaacgtgcggatttccattcccgtcaatacctcagcttccggaacattcggcgtcaccgcatagctgcgcggaattaacagctcttttaacgcggcctgagattcctcacgcagcagggaagcgcctcctttggcaatcatgacggggtcggtgatgacatgatcaagcccgtactgatccgttttttccgcaatttccgcaatcatttccgcgctccacagcattcccgtttttacagcgtcaggccgcaaatcttccgccaccgcgtcaatctggctgcccagcgcttcccgggtgagcggataaatgccgtgaacgcccaaagtgttctgggcggttaccgctgtaatggctgacatcccgaaaacgccgagctcctgaaaggttttgagatccgcctgtataccggcgccgcctcctgaatctgatccggcaatcgtcaatgctttgcatatgctcatgatgtttttctctcctttcgcattatccgatccatttatgataaaaggatttcgctctgctgatatcacttgtgccgtgtattaatgctctgccgtcacgaaacagtaccatcttgaaattgtctttgcaaaacgaaattaaatacgggttggctgaaacatcaagccctgtccgtctgagctgtcccgcaagtttttgcagatcaaactgttcagagatccccgctctgatctgcaccgtgttccgcccgcacagaaccgccgcttttgtctgattttcataggataaaaacggataatcgttcgtgccgcagcttgggcaatcagccgacttaagacgggtgacgtttatttctgaccgttcatttttccataaatcaaaagaacggagaacatgctcgatagatccgcccgttaacagcttcagcgcatctgctgcctgaaaaacggccgtctgcaatacagccgggctgatgattcccgccgtatcgcatgtcataccgcctaaaggcaatgtctcaagcagacagtgaaggcacggcgtgacaccgggaatgacggtaaaagagagcccgtagctgccgacacaggcgccgtacagaaagggaatccctttctgtacagccgcatcattcacaatcagcctcgtttcaaagttgtcggcggcatccacgatgagggaggcgtcacgaatcaatccgggtgcgttttccgcagtgacatccatgacaaatccctcgacctctacatcactatttatggatcgaagccgtttttcagccgccgcggctttcggcatttcctctctgacatcgtcttcggtatagagctgctggcgctggagattactccactccacataatctctgtcagcgatcgttaccttcccgacccctgctctgacaagcatctccgcacttgccgtcccaagcgcacccgcgccgataatcacggcatgagacgaccggagcttctcttggccggagggaccgatcggctgaaacagctcctgtctggaatatctgtccgtcataccggaagaccgtctcgcggactgcttgcagttccgtaatctttcaccggaattctccccgcttcataagaaaggcggcccgcttctacggcaagcttcatcgcccgggccatcttgaccggatcatcagcgcctgacacagcggtatttaacagcacaccgtcagccccgagctccatcgcgtaggcggcgtcttttgaagatccgacgccggcatcgacaatgaccggcaccttcgcctgttcaatgataaaggatagattcagcggatttaaaattccctgaccggaaccgatcggcgaagcacccggcataatagcatgcaccccgagctcctcaagacgtcttgcgagcacgacatcatctgacgtatacggaagcacgataaacccctctttgagcagctgttctgatgctttcagcgtttcaaccggatctggcaaaagtgaccggctgcatccgatgacttctacttttatcatgtcacaaagccctgaagctttggcaagccttgcgattcggactgcctcttcagccgttgcggcgccggccgtattcggcagaagcgtgtatttagacaaatcaagctgttcgagaaagttaggctgagactcttcaaagatgttcatccgccttaccgcaaaggttaaaatatctgattccgagacggccaccgcctctttctgaatctcaaaactcggatattttcccgttcctaacagcaatcttgactgaaactgttttccgcctattgttaacatcctcatccgcctcctacaaaatggacaatttctatgacatcgcggtcacacaaactcgtattttcataattctttttttcaatgatttctttatttctctccacaactacgattctttgatcaagctggtacgattcaagcaaatcctgaaccgtcccctcttttcgattccaatcaatttgttttccgttcagctgaaggatcatatatgaacagcctccttgcgatcgattcgaaacgcttcttcccattcctgtttaatctgtctttccatgatcataccccgcaccatttcagccgttgccggcgccaacaggatgccgttccgaaaatggccggcggcgaagatgatgccgctgtcttcaggatgccgcccgataaacggctttccgtctcttgttcccggcctgagccccgcccaaaaccggtctattttcatatgttcgacggcgggaagcatggttttcgcttttgcaatgacggcctcaattcctccgatgtcaggcgtatcgctccagtcgccgtgtttcatcgtggcgccgatgacaagccggccgctttttctcgggacgacataacaatgatcatggtaaagggttttggtcagcgggatatcgtcattccacacggaaaggcattctccttttacaggaaaaaaaggctgtcccaagccgagctggctgaaaaaccggccgctccatacaccgcttgcaactgcgactttgtcagcatagacatccccgccggacgttgcgatgcaatattctccgttcactcgttttacggaggtgacttgtgtatgctcatatatgtcagcgccatagcgccgcgccccttttgcatacgctttgcaaacatagtacggttcgacatggacatcgtcttttataaaacttgcgcctagaatgtcttttgaagcgtaaggctctttttcaagggcatcttccgctgaaagccaggtgacggaaggtagatcatccatcttccgcagacgggcgatatcttcttcggtatacgccagtttaagcattccgccgttatggcgcctgatgtcaatgccgcaagcttcctcaagctcttgccccgccgcttcatacagcctttgactgtgcatggcaaaatcaaaaaacgcatcccggttttcacattccgcatgagcgcccagcattcccgcggcagcgcttgtcgtttttcggccgacttctccggcttcaaacaagacaacgttttgctgcgtcttcgccagctcataagaaatggcgcacccgataattccgccgccgatcaccgccgtatcatagtgcttcttcataatcggcctcccttaccgcgcgtgcataccgttttgccgcctcctcaggattttcagctgagaaaatgcctgacatgacggcaattccgtccggcttcgcctgctttgtgtgtccgatcgtctgcagtgtcattccgccgattgcgataacggggatggaaagcgtgcgtttgatctctgaaagcaggctgatgcctcttgcttcaagtccttgtttacattcggtttcaaatacatggccgaacaccacataatccgcatcttccttttcagcttggatggcttctttcagcgaatgaaccgaacgtccgatatgaagatggggaaatctgcttcgcacctgctttacggaaaagctgcgggacggaagctgaacacggtgtatattggcaaaaagcgcgatatccgccctgtcattgatgatcaatttgtccttatccgcaccgccctttttcaaaagggacaaaagctgcatgatctctcccgctgttttatcccgctcacggatatggataaagcttacttcgcgctgaatcgaaagaatatcctcagccagctcggcaacgggtttgcgattatcagttaccgcgtgcagctccaaaggattccacctcttttccgcccttctcggaccagccttctttttgataagccattccccaaaattgatattcataatagcttgaaatcacaaaattctctttcattttcgcgcggatttcctctgtgctgttttcagcaatctcgtcaaaacggctgatctgttcttcgacttgctgtctgaaccagtctccgccgtatgtaccgatccatttttcataaatcggatgctccggtttgcactcctttaagtgttcgccgacttcataataaagccaataacagggcagaagcgcagctaatatttctccaaaattgccgctcatcaccgatctgtacatatgagacgtataagaataggcggtcggtgccggtttaaatgccgcacgctcttcttccgtaatccctaaaagctccgtaaactcgcggtgcagcgccatttccgcttcatatgtcccttgagcgtggcccgccatcctgcccgtcgtaaacaagtcttcggcatatgcggcgccgaacgcctgaacttttgcaaaatgcgtcaaatagtaggaatcttgcagcacgtaatagctgaaacggtctatcggcaggcttccgtcaccgattcccgttacaaacggatgaacaaaacttccgtcccaccattcggcagccgccagtctgcattcttcagaaaatgtcatcatgtcttcccccctgataaaataaaaaaaccactttcccgcatcggaaaagtggtttggaatttaaatggataaaaggaacccccaaaaaataccgctccacttccctacgcaggtctgaacctgttcaagttatgagggtctaaaagtctcacttttatctcagcccttatgaaggacacccctagtggtcatacgattaatgatttatttgttatgccttctatattatcacgaattgcaatttggtcaagcttcaaggatttttctcagttccgacacgtagttgcgcgagcccgtgacgatgagacggtctcctgttttcagcctcgtgtctccgtgcggaacgatgctgtccacacctctgaaaatccggacgaaaatgacatcgcccatcagcggaaattcccgcagaatgatgccgttatacgccgggttttccagattgatctgatataacgaagactcctcattcgtcaggaggctcatcacgcccggcgcctcaattaatgcgcgcaagagcgtctttgtagacagaaggatagaaaaaatactgatgccctcttctttcagttttgtttcatgctcaaccgagccgacgcttgcgatgatacgctcagtccctttctctttcgctattaaggcgatttcggcgttcacatcttcatttcccgtcgccacgacaagaatatccgttttgaaaataccgtgcgactcaagcgtgcctggctcgtaatcagaaatcgtgtcaaccgaaaaaacggattccgcaagcgtttccccggcattttcctgatacacatggacgacccgtacttcatattcctcatcgggcaattccagcgtaaccggaagtgtcatttggttggcgccgataaatgtaatgcgctttttttcctgcggcgcactttgccgtttgtataatttcttaaagccgatcggcgtgatgatgctggcaataaccgcaactaaagtcagcgcgccggacatattggcgctgataatgtggagcctttctccgatcgtagccgccgcgataacaagagacagcgtggacgtcagcaaaaagcccgaagcaaacacggttcttttgtcataccatttctttaaataaaacaccggaaacattttgctgataaacagcgcaagcagaagcagcggaatcatcgttaatgttttcggatcttggaaaagcgtccaaatgtccaatttcaccccgaccatgacgaaaaagatcggaattaaaaacccgtagccgaaggaatccagctgttccaccatttctttattcggagacagaagcgataccagaacgcctgccaaaaacgcgccgagaatattttccgccccgagagattccgataaagcgacaagcacgataatcagtgtgaaaatggctctcgtgccgatctgcacggtgcctttagacatcgactgcacaaatgaacggtgtttaaagatcctgccgaagaaatacagcacgacccccgcggcaaagagaatcaacagaagccacatatttccgctgtcttctccgtaaagagaagagaagaaagcgagcagaatcatcgtagccaagtccgcgataacggcgacaagcaggatgatctggccgatattggagttcataatccgttcttcctttaaagtcgggaccaccacaccgagtgatatcgtcgaaataataagcgtcattaaaaatgcgttttgaataaaaccggctaatacaaaggcataggacagcagcaatgataaaataaagatgccgaaaaagataatcagtgcggcagaaaacgtgttgggcgcttccttgccattcggaaggaattgttttttcttccctttctcaaatgaagaaaaatcaatttccaagccgcttaaaaacattaaaaagataaagccgagaacagacagcgtctccagccacgtgtctccctgaacgacaagattcaggccgctttttccgataataagccccatgatgatctccgcgacgacgacggggatgctgagcttaaaccgatgtaaaaggagcggcgtcaaaaaagcgacgatcagaacgacgactaaagatgcgactgatgtgtgttccattcgtaaatacctccttaaaacaagggttataaaagcccgcttaaagcgggcgaaaccttacttttttttaaaaacataacgcatattctaacaaggctgaacgcgaaaaaaaagtgataaggctttatttctttaattctttttttaatttgtgcaaaaacagcgtaattaggtataggaattagccccataataaataaaaaaacgttaataaggaggcagacacgaatggcttatgacatcatcagcgatatacacggatgttatgacgaaatgatcgcgttaatgcaaaagctcggatatgaagtcaaagacggaacgcccgttcactctgaaggcaggacgcttgtctttgcgggggatttaacggacagaggcccaaaatccgtagaagtgatgcgttttgtggcaaaagcatatgaaaaaggagccgtccgttatgtcccgggaaatcattgcaacaaactgtaccgttacttaaaaggaaaccccgtaaaagtgatgcacggactggaaacgacggcagccgaactgaaagagctgtctccagccgacagaacggaagtctccagacaattcatccgcttatatgagtcagcgccgctttatgacattttacataatggcgatctcgttgtcgcccacgccggcataaaagctgacgatatcggtaaatactcgcgtaaggtaaaagaatttgttctgtacggcgatatcacaggtgaaacgtatcccgacggcagacccgtcagaagagactgggccgccgcttatgaaggcaaggcatggattgtttacggccataccccggtaaaacgcccacggatcgtcaaccgtacaatcaacattgatacaggatgcgtcttcggcaatcaactgacaggctttcgctttccggagcatgaaaccgtctctgtggaaagctcaatgccctatgatgcctcacgatttcgcgaggatcacggaaggcaggcatgaaaaaaagcccgaaaccggcaaacggttcgggctttacatgtgttcaattaatgttttcatatcgtcaggcaccggagcgtgaaaaacgagcgtttttccggtcatggggtgtacgaatgaaagccgctcactgtgaagagcctgccgggcaattccctcattttttccgccgtacagtgtatcaccgactaacgggtggccgaggtagctcatatgcacccggatttgatgcgtccgccccgtttccagccgcagggctgcaagcgtaaacgcatgtcccgctttttccgtttgaaaatgcgtcaccgctcgttgtccctccggcgttaccatccgctcaataatactgtcgtgttttcttccgatgggcgcgtccaccgttccttccttctgcagcatgatcccgtgtacgacagcgagataccgcctgctgacaagcccctttttctgcgctgccgacaaaagagaatgggaaagccgatgtttggcgatcagcatcgcccccgatgtatccctgtcaaggcgggtgacaagatgaaccgttgattgtacgccgctttttcggtagtggctgatcactccgttagcgatgctttccgacgggtgttctcttgatggaattgaggagacatacggctgtttattgaccacaagcacatggtcatcttcataaagaatatcaagaggaaccggctcaggcaaaagcgtttcactcacatgctccttcggaaattcaatcttaagcacgtctccttccgctaacacggcgcggacggttacatgctctccgttcacaagcaggtctcccccgccgaatttaatgtcagcgagaagccgctttgaaatgccgagctgcgccgtatattcttttaccgtcatgccggcttcccgggcagtcatgttcttttggataaaaaagttgtccaatccgtttcctctttctattcgccttttccgataaaggagtcctgcacccttttccaaaacggaaaaggacggaatcttgcaaatctgactttttcatttgccacacggcatagaatggacttgacatccttatgcagcaaggttaaatgatcaattgtgacttgaaagtcgacgtcgtttctcggtttgatgacacagttatgatgatcgggaagcaaaagcggcgagccgacagtcctgaacactctgttgttgatggatgccatttccgcaagctgaatcgctctgatggaagggtggatgatcgcgccgcctaacgccttattataagccgtgcttccggaaggcgtggacagacataaaccgtctcccctgaacgtttcaaacagctggcctttaatttccacgtcagcgacgagactgccttctatgcttttgatcgtacattcgttcaaagccagataccgctcctcacgctcttcatcatgataagtgacaatcacctcaagaaggggatactccacggtatgatacggcgttttggcgatggccagaacgagcttttctatctcctgcggaacccaatcggcataaaaacccaaatgccccgtgtgaactccgacaaacgccgttttatcgagacggtcgctgtacctgtgaaatgcgtaaagaagcgttccgtcaccgccgacggaaatcacgatttccggctctttttcatccaaggtcatatcaaaatcgagtaaatacgcctgtattttgcttttcaatgtatctgaaacctcgtctccttttgaagaaacggcaaatttcatgccattcccctcctttcctactggtggtctcccgcttttttctttcgcgagaacgcggcttgggcttcctggatttctccgcggatttctgacatttcttcatcgagccgggatgcggcttctgaggcccgctgcagcctcagctttactttttcgggaatgttcccgctgtatttgtaattcagtgaatgctcaatggttgcccaaaagttcatggcaagcgtccgaatctgtatttccacaagaacgtgcttttcaccggacgttgtttgtaaaggatataaaacgacaaggtggtaagaccgatatccgctttccttatgctctgctatgtaatcccgcttatcgacaacggtaaaatcttttctggcaaacagcatatttttgacgatctggatatcatcgacaaattggcacatgatacgcagccccgcgatatcctgcatcgtttcaatctgatgaagcggtatgctttttcgtctcgctttttcaagaatgctcgccaccggcttcacgcggcctgtcacaaactcaatcggtgagtggtcatcttcatactcataaagggttctgacgcctttcagcttcacctttaattcttcaacagcctggcggtatggcgctagaaattgctcccattgtttgtcatccatcgtacatcccccaattccgaacctgttctaaagaaatacgtttttcactttttcttccatatctccgtagtttgcattatctttaatattttcaagaagataatcgagttcttcatgcagccctgaaagttcaaccgtttttccgccggcctcaaggaccgccggttttctttggtctaaggcttctttcagatccggccagacatgttcttttataatgacatattcaaaagagtcagctgattcaagtatgtatacaaaagcaaagtgatcggaatcaacaagcatttgacctgaggctttgcgttccgctccgcttaagtcctctccgcacttcaagcggagcgcgtcttctgttaatgatgcattttggatttcaattctcttttgcataatgttctccttttttaacaaagtacagcatttattttatcatatcaaggtcgatattgataaacgtaacctctaaagagataatgggaattatacaatttttcgtcctgaaaggaagactgtcatgacccaagaaatagaaattgaattcaaaaacctgctgacaaaatcagaatttctgaagctgagtgaagcactctgcatgaaagaacatgattttaaacagcaggtcaatcattatttcgacacgaaagatttttccctgaaacaaaaaaaatcagcactccgcatccgagaaaaagacggcgcgttcgttctgacgttaaaagagcctgccgcggtcggtctgctggaaacccaccaagagcttgcggcatttgatcttgacgtcttcaagattccggaaggccccgtcaaacgtcagctggaaggtctcggaatcaactcagaacacatttgctatttcgggacgctgtcgaccgcacgcgcggaaaaagaatcagaaaaaggcttaatcattttagatcacagccgatatttagagaaagaagactttgaattggaattcgaagctgctgactgggatgaaggaaaacgggcgtttgaacaattgctcaagcaattcggcatcccagagcggatcacgaaaaataaaatccagcgtttttatgaacagaaacaaaaaaaggtggaatgacacagtgaatatcacgaattgggcggcccttctccagctgcaatcaatggcgctgcaatcaatctctcatacaagcacggcttcaggcggacaatcttcagaaagcccgcttgcaaatttcagcgcgcttctcagccagtatacggacacagccgtccggcagcagccggaatcaggaattttaaacggtgtgcggaccgctcacgcttcatattcaccgagaattcccgtttcatccggctccgcggctgcttcacagaccgcttccccgggcataaagtctccggatgcggcttctgatatcagcaccggaaacttttcaatagacagcgccattcagaaagcggccgaaaaatacggagtggacgaaaagctgatccgcgcggttattaaacaggaatcaggctttaatccgaaagcggtcagcggtgcgggggcaatgggactgatgcagctcatgccttccacggcagaatcactcggggtgtcaaacccgcttgatcccgtccagaacgctgagggcggcacaaagtacttaaagcagatgctcacgaaatacgacggaaatgtatctttggcgttagccgcctacaacgcaggccccggcaacgtagatcggtacggaggcattccgccgtttaaggaaacacagcaatatgtcaaaaacataaccaaacagtattacgcgtaaaccagagaggcttccttcgccctctggtttttttgcggagtgaaatcttacacatgaatgaaggcgatgtgatatgatatgaaatacaagcgcctgacagaaaggcactttgtttgtagaaataaaatgttattgctaaaatatacagtaactgaagatagtaaaactgaaagataaattcgcaatgggaattatgattcctattagccatataaaggagtagtcaacatgggacaatcgtttaacgcaccatatgaagcgattggagaggaacttctatcgcaacttgttgatactttttatgagcgtgtctcgtctcatcccttgctgaagccgatatttccaagtgatttgactgaaacggccagaaaacaaaagcaatttttaacccagtatttgggcggacctcctctttatactgaagagcacggacatcccatgctcagggcaaggcatctcccctttccgattacggacgagagggctgatgcgtggctaagctgtatgagcaaagcgatggatcaggtcgggctggagggcgatattcgtgaatttctgtacgggcgtctggaactgacggccaggcatatggtaaaccagtcagaagcggaggatcgatcatattgacgaattatcagcatgagcaatacttcgcccattgccacggacatccaaaaaaaccgctcgaaatttacatgtttgtcgaccctttatgtcctgaatgctggtcgctggagcccgtcataaaaaaattaaaaatcaaatacggacgtttttttacgctgcggatcattgtttccgcgagtattacatcgctgaataagcaaaagcggaaaaaacaccttcttgccgaagcttgggaaaaaattgcgaaccgttccgggatgccctgtgacggaagcctttggcttgagcaggatcagcctctttcatcgccctaccttgccgcacttgctttaaaagcggccgaactgcagggaagaaaagcgggcattctgtttctccgcagcatgcaggaaagcctgtttgtttccaagcagaatattacggatgaagacgttcttttagagattgccgaaaagacgaaattggatgttgaagaattcaagcgcgacctccattcgcaaagcgcggtaaaagcgcttcagtgcgatatgaaaatcgcggcggaaatggacgtcaccgtcaacccgacattgacgttctttaacagcctgcatgatgatgaagggctgaaggttcccggcaactattcttatgacgtatacgaagagatcttattcgaaatgctcggggatgaaccgaagccttctgaaacgccgcctttggaatgtttcattgaatatttccggtttgtcgcatcgaaagaaatcgcactcgtttatgatttgagtctagaagaagttgaaaaagaaatgaaaaaactggcattcgccaaaaaggtcgccagagtggaagcaaagcacggtctgttttggaagtctctggccggcacccaggaggatgtcacctgttgtgatcattaaaaaaagctgattccttacggagccggctttttttgtgcaaataaagaaaccgcgccgggataagcgcggtttcatatgtcttaacgacaacaaaggggatgggagaaatttttcacggtcaaacaaaggggtaatgtttgtttgtgatcaatttcacatccttatcatatcaaatcttgtcgagttttgacaagccataagattaatgttcatatttttgtcacaaaacataactgactgcttgttttcatagaatatatcaatcataaacaaggagggaaatcaatgctccgcaccgtattgatcatcggaatgattgtgtttttcttctttttaaacctgctggccatgatgcacatgctgccgatttacattacatctcccctgctgtttctgtccatattatttgccctgtatcggctgaatcacagaaaaacgtttaaagggttttaaaaaaagcctgcgcatcttatgcacaggcttttttgaactacgaagggttcactttcgaaagaagctcttccatctcgttcagtttctcttcaaacattttgcaggccgcctcgatcggttcaggcgatgtcatatcgactcccgcttttttcagtatgtcgatcggatattccgagcttcccgcttttaagaattcggtatagcgctccaccgcaggcttgccttcttttaagatctggctgctcagcgcttgggccgcactgtagcctgtcgcatattgatacacataataattgtaatagaaatgcggaattcttgaccattccagactgatttctttatcaatcaccatgttgtcaccgaaatactttttattcagatcataataaagttcgttcagcagttcaggcgttagcggctcgccttcctgtgctttcgtatgaatcagatgctcaaattcagcgaacatcgtctgtctgaacactgtgcctctgaatccttcaagcatatggttgagcaggtacagacgctgtttttcatcctttaagctgttcagcatatattcaccgagcagcgcttcattagtcgttgaagcaacttcagcgacaaaaatgctgtagttaccgtacggatacggctgatattttctcgtatagtaactgtgcacggaatggccgaactcgtgaacgagcgtaaacagattattgacattgtcatgccagttcatcaagatgtacggattcgtgccgtatgtaccggacgaataagcaccgctgcgttttcctttattttcgtatatatcgacccagcggttttcaagtccttcttttaaaatagacgcgtattcctcgcccagcggagcaagtcctttgagcatataatctttcgcttcctcatatgtgaccttcattcccgaatcttttacgagcggtgtgtaaaggtcataaatatggacttcatcaaggccgagaacctttttccgcaggtcaatgtaacggtgtaataacggaagatgtttattgatcgttttaataaggttatcgtaaacttcttcagggatgctgttattggataaagccgcttcccgtgctgatttatattttttcacacgggcgtaaaaattatcttttttcacagtgccgctgagtgtagtcgccatcgtgtttttatactgtccgtatgttttatatacggcttcaaatgcgtttttgcggacttcacgattgctgctttccaggaaattaataaagttgccgtgtgtgatttgagtttccttgccgttttcatctttaattgacggaaacgtaatatcggcgttatttaaaacactgaatgtattggaaggcgacgacagcgcttctgaggcttccgcaagcagggcctcttcttgttcgctcagcacgtgcggacgctgttttgtaatttcttcaattgcatgggagtaaagtttaagctcctctttttccagaataaactggtgcagcttgtcctcctgaatcgccagaatttccggttcaatgtaagcagtcgcgctggcagcctgggaatacaggcttgcggctttgtcgttcagcccttggtagaaagaatttcccgtatcctggtctgagcgcatatgcgcgtatgcataaagtttcccaaggcggttcgtcacttcatcctgtgccgtaagcgccgcgtataaattatcagccgaatgagcaagcgtgcctttaaaagaagataaattcgggattaattctttaactgcttgaaattctttattccaggcctcatcactaggaaaaatatcctctagtctccatgtatgctctgcctttacttcacttctgtcaggcagctgtgctgctttattttcctcagtcatggtgatccccctcgttttctttacttcaagccaattgaaaaaacgattgtttctccaaaaacttgtgttgtgattatcttccggcttttcactgccttttgtcaaatcatatgcggcatataagaccgagcataccaataatacagtgaaaaaacgaaaacaaactgcttgtacgcccctcacattcgccaccaccttgacgttagggtgaacgaaatgaagcattctcattccccaaaaaagagcagatcccgccggcgcagctcttctgccgtttgagggagcttccgttgagatgagggcatatatacttcattctcaatttcccttaaaaaatcctgcaagcataagaaatcagcatattgttttaccgccattctgataaggctatcttgtgaaccataccgcatccgaatctccttacgcctgattttttgccgcaaatcatgaaccatgccggataatcggatcggcgtgccttttttagaaagttccgcaagccgcaagtataaatggctctgccacacaaaaacgggactggcaaacacaaagcccgctgaaacgggaataaacacttcagatgggagaaatggaaatgcaacctgatgtctttcgtaaaaaagacgccggataagaccggcatcttcagataaaaaccggccgcttttgtttcggaagccggctacggcacgtccccacgagggaagtctgacgctgtgcctcccttccggatgacaaatgtctttcaggtttgctttgtgaagagggattgtaattaagccggcataagaatagccggtgtaaaacggagtgatggaatgcagcctgtaaaaggagcgggcgtcggggcagtaaaacagtaaggaggaaaatgaatggacttcaaagaactgccagtgaaaagcagaaagccggaaaaattgcgcggccatccgttttaaccgttttgccccgatgatccagaccggccggtacccggcgtttttcaggcctgccgtccggctctttaaagagtccgccgaaaggttcgcacattgaaattcaaaagccagcttctcttctccgctttccgcggtcaagtcaggccgctgtccagcggaagtcagatacggttccaggctgacgctgcacccttgtgtctttagccagagaaaaagctgtctttttccttccagatggtattcgctttcaggttcggattcccccggacacagcctgctttttttatgagcgaagtgcggcagtttctcccgtcccagtttgatatcaagttcactttcgcaaacggggcagaaccagcgtttctttctcagctccgccgctttttcctttgaatagcttccggccagctgaatgagccgtccgtcggcagtcacagcactgaacatgttgcatcttctcctttcctgaatcttgttgtattcagcaggaagaagatataatcctgtttgcggatgagagccgttatgcggttttcagccgttcatcctgtcattcagaacaaaaaaaaccgatttctgctgagagaaatcggtttgttatgatgcaaagtgtttttttattgtatataacgcatgatcagcgatcaccaatttgccgtattcttcaagacggtgaatgctgactgatgattcgtgcgcgtactccaacaggatgcttagctgattttcaacctcttcatcagtttgctcataaaaatctgcatataaataatatcggtcttcaaacgaatacagggtcgttttgattccgttaagattcaattttgatagcgagatgagatcctcaaaatcatcgaaccgcaaagtgaactgaagcttttgctccttatcttcccggctctcggcctgctcttctttctggaaatcatcaagtaaagcatcgagattttcatctgccggctcttgttttttatcttccgggatcggcagttcgagtttttgtccgtccttggaaagctgggcttttgttacgattatttccagtcctttgtccaatgcctgaacctgaatccaaagaggaccctcgacagcgaattcctcttcatcatgcacttcatccatgacttcccagaacagttcttcactgcgctcgcgattgtaccagatttcttctctgtcaaaaccgcgatcttcaatatcaccataagacatataaaattttacagtatgctcattaattctttctatttccattttgccaaccttcccttctttataagatgttgaagggacatctaagctcccgatgaatagtactttactacactttacccattccgtccacatcttaaccttatagaagacagcgcaaattctttatatttctattttatgataaaacaggtataaaagaaataaaaaagcattttcacaccgaaaaacaggctttctcccggttcccatcataaatagcgcaccgcttcatatattagctgtacaagcaatcgatctataagcgaggtgttaccatgccgcacgattacctgctgtcccttctgctcattatcggaattgaccttattctcggcggtgacaatgccgtcgtcatcgcgatggccagccggaatctggcccataaacaaagacagcaagcgatcatcttcggaacgtttatcgcagtcgtcttgagaatcgttctgacgagcgctgcggtctatttattgaatgttccttttttacaatgcgcaggcggggtatttttattgtatctcggctatcagcttctgattgagaagaaagatgcgcagcatgtgaaaagcagttcttctctttggaaagccatccgcacaatcgttatggctgatatctttatgtcgcttgacaatgtcatcgcagtagccggcgcttctcacggtgagctgacacttgtagtgatcggtctcttcatctcggtgccgattatcatttggggcagcaagctcgttcatgccgccatggacaaaatgcctttattgatgtacgccgggagcggtcttctcgcatttaccggcggtgaaatgattgccggagacagcaagctgtcatttttcatggcagaacacggcattatacaaatgacgctgccgattttgaccgtcgtatttgttatcctcgccagtatgatttaccagcagactgaaaaataacaaaaagcccaaaccgcgatggttttgggctttttccatgcttatcgtaagcttatatcagttggcaagacgctgtgcttctcttaattggaaagaacgcacttttcttggcaggaatcgtctgatttcatcttcgttatagccgacttgcagacgtttttcatcaatgatgatcggacggcggagcagtcccggatgctcattgatcaaagtatataagtcttgaagcggcatagattcaacatttacgttcagtttctggaatactttagaacgggtagagataatttcatccgtaccgtcttcagtcatacgcagaatctgcttgatctcatcaattgataacggctcggagaaaatgtttctctctacaaacggaatctcgtgctcttcaagccaagctcttgcttttctgcatgacgtacagctaggtgatgtgtataatgtaaccattaatcttcactcctctaattagtaggatgaacatgtttgtattctcaaattgaaatgactttaaaaaaggaatctttataggtattatactataaaaaagtaagtgtgaacagtctcctgagaaaaaaatgtgtcaatccggcaaatttacggctggcggatgtttccccattctcaattagctcagctgatcgaaaatgttttttcgttttttctcatcaatgactttgagaacttcatccgttttttcgtatgattctccgtaccatttttcatctttataagtgtgaatgttttcatatgtctgtttcatcgcttcaaacatttcttcttctgattccgtcttaggtgaccagtacagaatctccattttgttcacttcattcgtagccaatgaccggcgccgatacccgattgactgcgcgtgcttgaaatgctctctttgataaaaacgcaagcgtttctgtgtatccgtgtcatcctcgtcaacaggctccacctcaagcagaatcggcttgtttttctttttcagcctgccgatcagcttgcttccgaggccttgtcctctggatttctttgacacaaacaggtaatcaataaagatgaaagagtcaaattccgcatacatcagcacgtggtactgcccctcttctttatgataaacatcgctttgctcctttaacagagcttccatatgcgcttttgatttcatttcttcaatcggaaaatattcactcagcttttcgtaccagttcattcatttgctccttatgggttcgttgtcttcacacttttagatataccccatttccgattgtttaaacaatcttacatctattaagacgtgtgatcctttaacatggtttcaatttttttaaaatggtgtgtaatcgacgtttttggtatagcggtttgccgcgtcccacaataaaaattcgtcaattccttcatcatgcagcgctttaacctggtcttccacctggcgttttccgtacttttgataatttccgctgccgagatatgatgccgtgaagtcctgaagccacggacgcgatacaggctggtgtttcagcttagacagttttttattttccacctttgcgtattctttgacgactttgtaaggctcaagatccggtttatcaatgccgaaatagcttgtccaatggctcgggtaaatcatggatgaaatgacatcgacctgttctgaaattttgctgaaattctggccgatcccaggcgcttccggcagcgtggctgaatagccgaaaatatcaaccgacacatccgcggcgtacggcttgagttttttcttcgcataaccgacaaaatcggtgacggcgtgaacgcgtttttgcacattgctgtctgctgtttttccgtaatcgccgtgtccgtatgtcagttcgtcatcacgtttttcaaatccttcaggaaaacggacataatcaaactgaatttcttgaaaacccatctttacggcttgttttgcaatctttacattgtaatcccatacttctttcataaacggattgacgaacgattcgccgcggccgtttttccagacacttccgtttttttctttaaaagaccactccggctttttgttcgcgagttcgctgtctttaaatacgacaatacgcgcgatcggatagatctttttttcctccagctttttcatcatcttttttgggtctttgatgtacggcttggcgattttggcatactcagaatggccgtccggcttaaaggtgaggtttccgttgtcatccttgacatcaatcaccattgtattgagctccgttttgtccacaaagtctgtcagctccccgaatttgcttcctcccgctgaatgccctgtgacgtaaatgccccgcaccttatcaggatgtgaaaaatgcagccctgacggataagcgaaccgtgcatttgatttcggcagttctttttcggccagcgctatttttacaagcggctgctcctctttcgcagcggcgtgggccggataagcggctgcactgataaacagtcccgcacaaatggcgcacaaaatggttttcatactgatctccccctttttttccattatagaaaaacgggagcaggcttaataaacttgaatgtgcgcaaaaaaatcctccaagactgagtcttggaggatgatacgtttatagataggttttaaattcagcttctgtgcacatgacaaaatgtcccggtttcacttctctgaattccattttttctccgtcttgcagctgatgaactgccggatcgtatttctttcgcgtgcgatttctttcatagtccggatcagggagcgggatagcggacagcaatgatttcgtgtatgggtgaagcgggttttcgtaaagctcatccgccggcgcaagctccaccaattttccgaaatacatgacgccgatgcggtcgctgatgtatttgaccattgataaatcatgggcgataaacaggtaagtgagccctttttctttctgcaattctttcattaaattgacgacttgcgcctgaatggagacatcaagcgccgaaatcggttcgtccgcgatgataaactccggatcaaccgccagcgctctggcgattccgatacgctggcgctgtccgcccgaaaattcatgcgggtagcggttggcgtgctctttatttaaaccgaccgtttccagcagttcgtgaacccgctgcatccgctcttttttcgtttttgccaggcggtgaatatctattccctcggcaataatgtcggcgactgtcattctcggatttaaagatgcgtacggatcctggaaaatcatctgcattttccggttaaactccagcagcttcttgcgggattttttcccgtgcacattttccccgttaaagagaacttccccgccggttgcctcatacagccggataatgctgcggcccgtcgttgatttaccgcagcccgattctccgacaaggccgagcgtttcgcctttataaatatcaaatgacaaatcatctacggcttttaccgttcctttctgcgtgaaaaaatgctgttttaagtgtttaatttcgagaagtttctcagtcatttttttcaccttccttcattaaaacaggatgctgatacgtattcggaagctgacggattttagccttcaccgcttcaggcggctcgaccttaggcgcatcaggatgcagaagccacgatttcacgaaatgcgtatcagacactttatacatcggcggttcctgttcaaagtcaattttcatcgcatatgagctgcggagcgcaaatgcatcccctttcggagggttcgtcagatcaggcggcgtgcccgggatggccgtcagtttttcctgatcggtgctgtccaggctaggcattgaggcaagcagtccccacgtatatggatggcgcggatcataaaagatttcatccaccgtgcccgattcgacgacctgacccgcgtacatgacagcgacccggtcggcgacattggcgacaacgccgagatcatgcgtgataaaaatgatagacgtatcaattttcttttgcagatctttcatcagctcaaggatctgtgcctgaatcgtcacatcaagagctgttgtcggttcatcggcaattaacagtttcggatttgccgcaagcgccatcgcgatgacgacacgctgtctcatcccgcctgaaaattcatgggggaattggccgatccgtttttcgggcatcggaattccgacgagatcaagcagctctatggcgcgctttttcgccgcttcacttgagattttttcatgtttgaaaagcacttccgtaatttgtttgccgactctcatcgtcgggttcagagaggtcatcggatcttggaaaatcattccgatatcctttcctctgatggcctgcatttctttttcagacatcggcacgatatcgcgtccgtcaaaaagaatctgtcctcttttaaagtagcccggcggcatcgggatcagcttcataatcgcttgggaggtcacactttttccggaacccgactctcccacgatcgccagcgtctctcctttattcaaatggaaattcacgccgcggattgcctgtacctctccgccgtatgttttaaatgaaatggctaagtcttttacttctagcaaacgtgtcactcatatcactccttatttgcgtaacttaggatccagcgcgtctcttaacccgtcgccgacaacgttaaagccgaacatcgccaggcagataaagccggcagggaagaacagacgccaagggtaataggttaatgcaggcaatccgtctgaggccatcgttccccagctcgcaagcggcgcaggtacgccaaggcccaaataacttaaaaacgcttctgtaaaaatcgccgtcggaaccgtcagtgtcatcgttacgaggatagagcccatcgcgttcgggacgatatgcttaaacaaaagccggccggttttggcgccgagtgtctgtgaagcaagaacatactcctgattctttaattgcagcacctgtccgcggacgattctcgccatattgatccagcccgttattgtcatggcgacgataatggtgagcaatcctttcggcagaacaaccatcagcaaaataaccattaataatgaaggaacagcccacagaatgtcggcgatgcgcatcatcacttcatctgtgcgtccgccgcggaaaccggaaatgctgccccagattacgccgattaataaatcaagcacggcagctgcgacaccgataaagatagaaatccgcgcgcccacccatgtccggacgaatatatcccttccaaggtcgtccgtgccgaaccaatgatctttcgacggcgctttatccgcatttaatagattggtagtggcataatcataccttgaaaagacaggcgcaaaaatcgccatcagaataataagaacgatcagtacgaacccgaccatcgcaagcttattgctgcggaagcggagcatggcgtctttccagagggaaaggctttttttatttattttttcggcatcgccggcattagctgaagctggttcaaacatatttttaggaatgttctgcatggtctaggctcctttctttgctttggaaagcttgattctcggatcgattaatccgtacagcacgtctacaattaatacgcataaaagcaggagcacgctgaagaacacggtaactcccataatgaccgtataatcacggtttgtaatgctgtttacaaaatgcgcgcctaaaccgggaattccgaaaatggattcaatgatgaaacttcccgttaaaatggatgccgccatcggccccatatatgtcacgaccggcaaaagcgcgtttcgaagcgcatggcgcacggtgactgacggacgggaaagtcctttagcttttgcagtccgtatgtaatcgctgtttaacacttcaatcatgcttgaacgggagagtctggcaatgaacgccatcggcatggaagcgagcgcaatagagggcagaaaggtgtatgcccaggattcccaccctgcgaccgggaacagttctaatttaattgagaaaatatattgcaaaatcgtcgccaatataaagctcggaactgagatcccaaagatcgttaaaatcgcaatggtataatcctgccatttattatggtacagggcagcaagcaccccgaaaagcacgccgaacgctaaagcgaggagaatagcttctgcaccgagagtgaatgagacggggaagcctgaattgattaaatcattaacactttggcctttatatttaaaagaaggtccgaagtcccacatcgccacagattttaagtagctgacatattgaacgaaaagaggcttgtccaggccatagtgttcgtttaagtttgcctcaatttcaggcggcagctttctttcgccggaaaatggtccgcccggcgctgcctgcattaagaagaatgtggcggtcacaatcacaaacagcgtgatgatcatgtaaatgaatcgtttaccgatatatttcagcaaggtgaacacctccatgttttttacaattttatacttaatcagtaagaaaggtatatggggacatcctccccatataccttgggtcttttgttttcagaaccgtcttttattcaaaagaagcgtttctgaagtaaacttcgcctgttcctgtcaagatcacatttttgaggtttttatcctgcacccaaggatccgtatagaaataaactggcgcgaccggcattgcgtcaataaagatcttttctgcttttttcagctcttcgatacgtttatccggatccgtttcaagctgagattggttcagcagctttttaaactcaggatcttcccatccggtatcattgtttccgccttctttatcacggaacaattcaaggaagttgatcggatcgttgaaatcgccgagccagcccatacgcccgatttggtagttctggctgtgcagcttatcgatgtaaacattccattcggagttatcaagctcaactttgacgcccaagttctttttccacatttcctgtacggcctgcgcgattttcgcatgcgcgtcatccgtattgtaggacagtttgatcgccggaaggtcagaggcattcttgacgcctaattccttcagtcctttatttaagaattctttagctgatttgacgtcattgtctttgaaataaccttttgtgttatccttgaatcccttcattgacggcggcaccgcagccatggccgggatctgttcgccctgcgttacattttttacgatggacgagcggtcgatcgcataagcaagggctttacggatgttaacattgttcagcggtttcgcttctgtgttgaatttgtaccaatacacgcctgcgatcggttcaacgtgaagagatccgtcttttttcaaggtcggcagagattcagtcggaagctggccgagcggcattcctgcccagtcaagctcaccggcctggaattttttcagttcggtgttgttattgttaatcatcaccatgttgattttcttcaatttcacagcgtctttatcccaatattgatcgttcttttcgagcgtgatggaaccgctgtgtttccaggccgtcattttgaacggaccgtttgacacataattttcgcccgcgttggtgttccagtttttatgtttttccgcgattttcttgttgatcggcatatacgtatagaatgaagttaattgcgtgaaataaggtgtcgggttattcagttcaacctttaatgttttgtcatttacggcttttacgcctacatcatcaatcttgccttttcctgtattggcagcttcagcgcctttgatatagtagagctgataagcgtattgtgattcgttgttcgggtcaagcgcccatttccatgcatattcaaaatcctgcgccgtcacagggtcgccgttagaccatttcgcaccgtcacgaatcgtaaatgtataggtctttccgtctttgcttgtttcaattttagatgccattccttcttcaggctcacctttggagtttacgcgtgtcaatccttcaaaagtctgtcggattacgcctcctgacacggaatcattcgctaaacccggatgcagtgagaacggctcggttttaatattgatattaagtgaagtctgtcctttggtgtcttttttaccgccgcctgatccgccgctgaatccgccgcacgcacttaatacaagcgagaagataagcatcaaacctacaatagaccaacgctttttcatgcactaaccccctaatcaaatttttcagcctttactactaaatactcagaaatatcagacaaaataacttaatatttttctaaactttaattgtgttccgtcttttctgattattttatgtaaagaagctgtaacaatagagtgaacaagttcattataatgaaatgaataatttattgcaatactattttctcaatttaaaatatttaaatttggtcagtttttctgtcaaaaaggtgatacacttctatagtttaaagcatgacctaactaaatttttttattgtaatttccagttcatattgctttttacatataatattcgttatacgaaatgttgatatgcgttatcatttaagcattttcagttctttttgaggatttccacccctaaagcaaactggaaataagcttgtattcctctgatgacatttggctataattgatttataatagatcaatcaaatacatttgttgtgattgcgatgatgaagagtagtacacattttcatccgtttgaagagagtctgcggtgctgggagcaggtaacgggcgatgtggaatggacttctgagcagctgaccgaacgttagtaggcccagccggagcagcctccgttaccaacgtctcgagcgattccattgtaatggaataatcagggtggcaccacggttcattcgtcccttttttctacgggaagaatgggctttttttattatgttttaagaaatgaggtaagaactatgaagaaaacgattttttctggcattcagccgagcggttccgttaccctcggcaactacatcggcgcaatgaagcaatttgttgatttgcagcatgactacaacggctacttctgtattgtcgatcagcatgcgattacggttccgcaggatcggcttgagctgcggaagaacatccgcaatctcgcggctctttacctggccgtcggacttgatcccgagaaagcgaccctctttatccagtcggaggttcccgctcatgcccaggcggggtggatgctccaatgcgtcgcatatattggcgagcttgagcggatgacgcaatttaaagataagtcaaagggcaaagaagccgtcgtgtcaggactgttaacctatccgccgctgatggccggcgatattttactgtacggaacggatcttgttccggtcggagaagatcaaaaacagcatcttgaactgacccgcaacctggcggaacgctttaataaaaaatacaatgacatcttcacgattcctgaggtgaaaattcctgaatcaggcgcgcgcatcatgtcactggctgatccgctcaaaaaaatgagcaaatcagatccgaaccaaaaggcattcatcacgctgcttgatgaaccgaagcagctcgagaagaaaatcaagagcgccgtgactgattctgaaggcattgtaaagtatgataaagaaaacaaaccgggcgtttctaatcttttgacgatctattctattttaggaaacacatcaattgaagaattagaagctaaatatgaaggcaaagggtacggtgaattcaaaagcgatttagccgaagtcgttatcggcgcattgacaccgatccaagagcgctaccgtgaattaattgagagcgacgaacttgaccgcattctcgacgaaggagcggcacgcgcaaacaaaacggccggcaaaatggtgaagaaaatggaaaacgccatgggtctcggacggaaaagaagataaagaaaagaggcgggagaatccccgcctcttttttagttcacttttgattcctgttccatttcccaaagcttttcgaaaaatggctgccctttaatcaaattttcacagaacgcaagatgtttatctgaccagccttcaattgtttcattgtaaagcatgtcccaaatctcttcaaagctcatccgtttgatctgctcgtacatatgcggattccactccgtgtaccaatacacaatttccgcacggtttttcagccctttcagctggtcgagcgccataaacatcagctgcttgatctgccgctcttttctcgtcagccctctgacgtgctccggcgccaatgacaaaatgtgatattcctttgaagactccaattgcgccggcttaaattgaaacgattccggttctacatcctttaccatttcataaacaagctgctcctgtctcggaatcaggcggctctttctgaccggaatggtatacccgatcgtatccacggcaatgatgccgatcccgtctgtcacgacaaaacaatactccagctttgtccgctcatgattttttcgcacgtatgacttttggtggacttggtcaagcagctctttcggaagctctgataagtcgttttctatgtaatgaaataataccgacggcactctgagcagcggcgtctgatccaaaagttcaaccgtgtcttccttccgccattcgtgaaaatggcatacattgtagccgttttcttccccttcaaaccaattgacccatacatcatgaagaaataacatattcgacccctcactttataaaaactgttgtccacagtataggcaagggatagataaattattccatttcaatatgagatttccgcattacggagctggatttccgactgcatcgcaacaaaaaaatctcccgttccgtccgggagatcatttcacatttttcggatcaagcgcatcacgcagcccgtctccgacaaagttaaagcacaatacggtaagaagaatcaacaaccctgggaataacgggtaccaccaagcctgaatcataagcgtaaagttctgtgcatcctgaagcatattgccccagcttgcgatcggcggctgaatcccgaaaccgagataacttaatgtagattccgccaaaataaccgttcccacctttaatgtggctgagacaataatcggtccgagcgcattcggcaatatatgagaaaagatgatgtgatgattttttgtaccgatcgtctttgcagctaatacaaactctctggaacgaagcgataaaaactcccctcggacaagacgtgccgttgttgtccagcctgtaagggagaaaattaaaattaatttatccattccgggctggaaaatcgtaacaagtgtaataagcaaaaatatatcaggtatggataatacgatatcaacggttctcatgagaacggcatcgacaatccctttaaaatatccggcaacggctccgacaactgtcccgattgtaatcgcgccgatcacagaagcgaatccgacaagcaaggagacgcgcgccccgtacagaaccctcgtaaagatgtctcttccgaatttatcagttcccattagatgttttaagctcggcggcttcaaacgattgataagagattgactctccggagagtaaggagcgattaccgaagcgaataaggctgacaagatgatgatggttaatataacggctccgattacagctagtttattttgaaagaacttttcgaaaaaaatcttcgtcattgtttccggtttggattgaatattttcctttaattttacttcgctggggggtgtgccggtatttggctgtaacatttgacctctcacctctctttgttaatattcaatgcggggatcaaccagcgcatataagatgtccgcaattaaattccccaccacaaccaaaacagctgaaatgaccgtcatggccatgataaccggataatcccgcgaaaaggctgaatcaataaacaatttaccgagacccggccaagtaaaaatctgttctaccactaccgctcccccgataaatgacggtatcatcagaccaaaaatagtgatgacaggaagaagtccgtttctcaaaccgtgtttaaaaattactttattatctcggaatcctttcgcacgcgccgttcgtatataatcctgttttaacacatcaagcatactggatcttgtgtatctcgttatccctgccatgtctgccgtagcgagcacaaaagcaggcagaatcaagtgatgcaatcggtcaaatatgttaaagtcagcattcaaagtgcttactccgccagtgggaaaccaccccagatttacagataaaaccatgattaaaatcaaaccgaaccaaaaattcggaatggcaagccctaaaaatgaagtaacagttatcccgtaatccaattttgaataaggacgtttcgctgacagaacaccaaatggaatagaaataagaagagcgacaagggttgagaaaagcataagcacaatcgtattcggtaagcgggataagataagttcagaaaccggagtgcctttcttgacgatagaagtcccgaaatccccttgcagcatattccccagccatttcacatattgaacaggttccggatcattcaacccgtatttttcaatgaattttgccctgtccgcttgactgattgtagggtccatcataagtgacatcgggtctcccggcgctgctttcatgatggcaaacgacaaaattgtaatgcctaagagaatcggcaaggacattaatgttcgccgtaaaatatatgtaaccatgttcttgtcccctttttaaataggataagagaggaaaggaacctccttccctctccagggcttttgctatttttgatccagccaccatttttcaatattgtacaagtcatttttagggtggaatacataaccttgtaaattattcggcatcgctctgtggtaattgtaatagaataagaagctgtacggctgatcttcagcaatcaatttgtatatctcttcatacttcttttggtattcttttctgtctgtaattgtcttcgcttcttcaagcagcttatcgactttcgggtttttataccagatattattcagcccgtttttcgattggcttgaatggaagatagagaattgatccgggaacgttgcaagactccatccgagaagaagagcgtcataatcccaattaggggcacttgtctgttcgattaacgcactgaattcaacaattcgcggtttagcctcgattcccacttcttttaattgctgctgaacgacaacagctaaatcttcacgaattttattgccttgattcgttttaatttcaaatgagaatttttttccgtctttatcaaggtagccgtcaccgtcatggtcttcccatccggcttcttttagcagctgctttgcttttttcggattataatcaaatgtcggcactttagacttcggataattccatgacagcggactctcaggaacatccgctaccttaccgtctccgttcagcacttgatccaccattgcctgcctgtcaagagcgtaagtcaatgcctgacgcacttttttgtctttaaagatctcttttttctcattccagccgatatagctgtagtttaaaccaaggtcagatttgaccttcacatttccaaacgttttaaccgtatcaaaatctgtgcccggcacaacgaagaaatcaatatcccccgcttttaactgagccacggccgcgttagaatcaggtattgtttttactgtcactgtatcaaggtaaggtctgccgccaaagtaatcatcatttgcttccagtttgacatactcgccctttttccactcaacaaacttaaacggaccggaaccgattggatttttacggttaaattcattctctcccagatctgcaaccgggaccttacccaatatatgtttaggcaaaatgccgtaactgtcgagaacgacattatagaaataggcatcttttttcttcattttaaactgaatttcatattttccttttttcgttacggatttaagggactcaaaacccgagccacgctcaccgttgtaatctttgttaagagggatgctgtaggtgaaaacaacatcatcggccgtcagctcttttccatcatggaatttaacgccttttttcagttttacatcatacgttaatcccccgtcagcttctgttactttttcagccagcgacggcttgacgtttaatttctcatcagtttccaataatgtgctgtaaagcattccttcaatatcagaacttgcaacatcagtagaataaagtggattaaaaagtgtgggttccccggttgacccgacaaccaaatctccgcctttttgcggttttcctgccggtttggattcggtgcttgtggattttgagccggagcaggctgacaggaagatggcaaacgccataaaaacacttagcatcatcagtgcgcttttacgtaatttcatatcaattccccctttgtgatatatatgcagcaaactggttatgtaatccggcataccccctctcgatgcttgtcatttcaggcatataaatggcaggcaacgtaatggccgggagcggcttcttcaaatgccgggatttgttccttgcagatcggtttggccatcgggcaccgcgtgtggaacacgcagcctttcggcgggtttgccgggcttggcagttctcctttcaggatgattcgttcccgcttgacggcgtctttttttctcgtgacgggcactgaagacaaaagcgcttgcgtataagggtgaagcggattgccgtacagctcgtgtttatcggtcagctccatcatttttcccagatacatgacgccgactctgtcgctgatatggcggacaacactcaaatcatgagaaataaacaaataggtcaggttgaattcatcctgcagttcttccatcagattgatgacctgggcctgaatggagacatcgagtgcggaaacgggttcatccgcaataatcagctcgggattcaacgtcagagcccgcgcaatcccgatccgctggcgctgccctccggaaaattcgtgcggatagcggtttgcaaagctcggatgaaggccgactttcgccagcagctcctccactcgctcgttccgctcgctcatgctgtacatatggtgagtctggaacggctctttaataatggaacgcagcgttttcctcgggttaagggatgcgaagggatcttggaagaccatctggatgtttttgcggacgctttttctcagcttttcttcagataagccggagatatcctgacccttaaaaagaatccggccgtctgtcggcttgtataaacggatcatcgtccttcccgccgttgatttgccgcatcctgattcaccgacgatgccgagcgtctccccgcgcttcagtgaaaaagaaacaccgtcaacagcctttatatcaccgactttcctttgaaaaaaaccggagcggatcgggaaatatttttttacgtctttcagctctaaaatcgtttcttggcctgcagctgtcattttgattgggcaccctcttcctcatataaaaaacatcttacagaacggccgctttcatgcgttatcagctccggctgccctgttttacatttgtccatcgcttttgaacacctcggggcaaatcggcagccttccggaagattatccggtgtcgggacactgcctttgatcgcttttaatgtatcaatctctccatctatcaccggtatggagtttaacagcccctcggtatacggatgaagagggtttaaaaataagtcctccacactcgcgctctctacgacttgtccgcagtacatcacgatcaccctgtcggcggcttcggaaaccacacctaaatcgtgagtgatcagcagaatggaagtatcgaattttttgcagaggtctttcatcagctccaatacttgggcttgtatcgtcacatcaagcgccgtcgtcggctcatcagcgatcagaagcttcggattgcagctgagcgcaatggcgatcatcaccctctgtctcatccctccggaaagacggtgcggatattctttcattacttgttccgctctggagaatccgacgagttccagaagctcaacggcttttttagccgcttcttttttattcatttttttatggtattcaagcacttcggtaatttgttcgccgatggtcagcaccggattcagggaagtcatgggctcctgaaagatcatagagacgtcatttccgcggattttgcaatattcgttttcggtgaaggaggccaggtccctgccttcaagcttaatcgagccgtccataatttttccgcccgagccttggacaagtcccataatagaaagcgaggtgatgcttttgcccgagccggattctcctacaagagcgacggtttcgcctttgttaatgtgaaaatcaaccccgtcgactgcggggatcggctgtttctttctgaaaaaataggtctttaaattattcacttctaatagtgtgctcatgatacgcccctttctcattccgctgaagcagagggaaacatacgtttcgctatcacaaaatatagaatagtcgaaaaattttatagttgtatattattacatcattattacaaaagcaagaattttttaggataaatgtaatatccttaaataatttccattcttttaatctattaaagcgttgcctccagaaaggtttttgaagggatggccaatgcttcttttactgttttttgatggccggttaaatatttttttactatattgaatccgacggcatagccgagcattgaggggaagtatccttttccgtataacagctgggaaaacattctgctgtctctcgttaagcggaggttcggcttgactcttttttcaaacagaaaatcaagctgctcaggcgtatagtaggacgtccattccgccgtaagacttgagccgaaccgctcatatacagcatattctgccagcccctccatcatgattgtatcaagaaatgtctcatctttttcgtcctttgtcacatgttctaaccggcagacgtgattatattcatgtgtcataagggcggatacagctgaattggaactatccgacgatagaaagaggaacattttgtcccgaaaggccagaccggattttgatccgaattcctgacggattttccggtttcgttcgtcgacgggcaaaactacgatcggcacgtccggcccgttccacttctcctttaaataagcttcctccttttgaatatggctgtagcatcctttttctttcagccgtttactggtcctaacgccgtccttcaaatggcggaacatgccgtggttttgcagcatcccgagtatcggcttccactctttcttatcggcccctgcaaaaagcggcaaaagatgcggggccagatcatttacggatgccgccttttccatccattgatatgtctgcttgacgctcataccggttcgcctcctcttgttgttatcatatgcacacacaaaaaaaccggccacctttttcaggcagccggtcaaaactgtattattgatattttttaaagatcaaagtggcattatgtccgccgaagccgagcgagttgctgagaacgatgttgacatcctgctcgcgcgctttgtccggtacataatctaaatcacactcttcatcaggtgtttcgatgttaatcgtcggcgggataatgctgtctttaatggccatgacggagaagattgcttcaattcctccggcagcgcctaacaaatgacccgtcattgattttgtcgaactgacggcgagcttgtacgcatgatcaccgaaaacggtcttaatggcttttgtctcgtatttatcattgtagtacgtgcttgtgccgtgagcgttgatgtaatcaatttcttcaggcttgatgcccgcatctttgattgcttcctgcatcgctctcgcaccgccttctccgtcttgggcaggcgcggtaatgtgataggcatcacccgttgagccgtagccgacaatttccccgtagattttcgcaccgcgggcaagggcatgctcaagctcttcaagcacgacgatccccgcgccttctcccatgacaaagccgtcacggtttttatcaaacgggcggcttgccgttttcggatcaggatttgtagaaagggctttgtttgcgctgaagcccgcaaatgacattcttgtcagcggcgcttccgttccgcccgtaatcatcgcatcggcatcgccgcgctgaatgactttaaacgcgtcaccgatagagttcgttcccgtcgcacatgccgtcaccgtacaggagttgactccttttgctccgagagcgattgagatttggcctgtcgccatatccggaatcatcatcggaacaaagaacgggctgacccgtctcggcccttttgtcaggaagatttcgaattgggattcaagcgtttcaagaccgccgattccggacccgacccaaacgccgactctcggcgcgatctcgtctgtgatgttcagaccggcatcttgaacggccattttcgcggctacgacagcatattgcgtgaagcggtccatttttcgcgcttcttttttatccatgtaattttcaatattgaaatctttcagttcagcagctactttcgccggatactcgtccgattccacacgtgtgatcggtccgattccggatacgccgccgattgcatttttccagcttgtttcggcgtcgtttccaagcggagacagggctccaagccctgtaacgactactctttttttactcatcttgtgtgcacctcacctttttttatcgtccccagcgtattgctatggcgccccatgtcaatcctccgccgaaaccgaccatgacgatgacgtcgccgtctttaattttgcctgcttccagttcctctactaatgaaatcggaatggatgctgcggatgtgtttccatatttatggactgttttagacatcttttcaaccggaagctccaaacgttcccgtgccgcttccatgatgcggatgtttgcctgatgcggaatcaaaaagtctacgtcctctttggagaggccggctttttcaatgacatttacactcgattcacccatttgccggacggcgaatttgaaaacttctcttccatgcatgattgtatgtcctttttcatctaagtacaagtgctgaccgcctgtaccgtctgctccgagctcaaatgacagtatgcctctgtcgtcgctgaccggtccgatgaccgccgctccggctccgtctccgaacagcacagccgtattgcggtcgtcccagtcggtaatgcttgagagcttttccacgccgaccacgaggacatgtttgtatgtttgcgattcaatgaattgtttggcggttacgataccgtacataaaacccgcacatgcggcgctgatatccatcgcgcacgcttttttggccccgagcttctcttgtatcatacaggaaacggtagggaaggactggtcaggagtaaccgtcgccacgaggatcatatcaagctcctcagcggaaatgccggcctgatcaagcgctttttgcgcagcctcagcggccatgccggatgaatacatatcttccgcggcgattcttctttcttctatacctgttctcgtacgaatccactcgtccgatgtatctaccatttgttcaagatcatgatttgtcagcactttttccgggatgtaacggccgacgccaagaattccagctttcattggaaagactccttttttataatgaatttaaaactaattagttatgatcaattattagtatcaggtactaattctaccctattttttttctgttggcaatatattcgtctaaactatcggacgctgctcctcatagaataaaaggaagacgaaaggaggcttcactatggatattttctccaaaatgatgttcggcgattccagagaccgggataaagaaccggaagaaaacccggagcagcctcaggctgaaaacgaagaagagatcgattacaaccacgtgatgaatcagctggggtccatcatgaactctctggatcaattaaagcctgtatttaaagacttcgcgccgatggtgtccgctataaagaaaaaaatcatgtgaaaagccacttcatgaaaagtggctctctttatttattcagctccccggcatcagatctgccaagctcatacgcttccgccatgaccgatgtaaacaggtccataaacggctgaatcatttccaaagacagatctatgccggatttctcaagctccgcctttgcttccggcaggtatttcatcgcgatctgcataaattcaagagacttttcatgctgcatgtgtatccacctctattcatttgacggcagttcatttgttcggttatacgtttttacaaggtctgagattttgtcttgaaatgctttgtccaccagagggctgaacgtccccatttcaacgactccttccctgaaatcaaagttgtgatctccgctcttgagcgtacctttattatattgctcggcaattaatgtataggctttatctacgttttgcaccgtgcttgtcagcaccgtgtttttgccgagattcgattgctcggcgacatagccgatggcgtaaagcccgtcttttttgatttgctgaatgacaggaacattatacccgtctccggccggatatacaacatccgtgccttccgcttttaacttctcgtaaagatgcagcgcttcattgccgttatcccagtggtccgtaaattcagtattgacggtgatatcaggcttttcatatttcgcccctttgataaagccgtctacttcaggctgccacaaaaaggaggcgatgacgccgacctcattggtttttgacatatgggcggctgtcattcccccgaaaaaacccattgcttctcccataagatgaacgcttgtgacattatcgcttttcgccgttccgtttgcgacgacgaattccatgtcgggataatccttgctgatcatattgaagatttcctcgtattcatttccgtgcccgtataaaagattgactccttttttatgaaaatcatctatcgcttttaaaatatcttcatcggatctgatattttctttataataaacgtcaacgttaaattcagattgtatcgctaataaacctttgtaaccttttgtgccccataccaagtcactgatagtatcgggaaaaagcattccgaccttctcaatttttcctttaaacggagtttgtgcgcatccgctcaataaaaggaggacagaaaagatcatgacaagcctggtgatcaagccatgttcaaccccttttcaaactcataacatgtataattgatatacgtttattgtagcggtaatgcacataacatggaaggtatttcttaaaaaatgtcgaatattgatgaaaattgtcttttccattctttaattttttcttccgcttccgttttttgcgttttttcttttatttccagggtaataatctgattttcgtcttctgtgccgtatgcctcaagctgattcatcagcccgcagactgcgtcttctaaaaagatcctgctttcgccatcttcttttgcttctgtccacggaccgtaaaggggaggaaggataatcgcttttgccgtatcccgctgaccgtttttttcccagtctccgtgatcctcactgtaaacaatccaatataaaggctcagccctttcttcaggcagacacccgctcccgtattgaacgcagatacgatcgtattccttttcaccgatttcatctattatttgaaaaagcccgtttctcgcgagccacattaaacgttcttctaaatacagctgcctcgttttgtcctccggttctgccaaaatgacatcaacatgcacaccctcatccatcaaccgttcgcacaatgaaaggccgagaaattcatctgctccaatgatcagcgctgtcttcatcacatctgccgcctttccggtttttcattcgcacacaagccaaacagccctctgaaaagagatggctgttgtattctattcattacaggtctttttcatgactgcggaaaaaccggcagatggctctgtacatacgcgcagggttctcaagcaggtgatacgtgatatcagtcttgcttccggtcttttcccgggcttctttatacgcattcgcatgcagggtgtacgggtacggcgctccggtcgttctttgccatatatgtaccggcacgcgggtgcggcagccggtaatggtctgatagctcagtgagcttgcctctttttcagaaacaccgaagctctgtgccgtttccctcagaaactgcttataaaaaaacttattttctttctctgattcaaaatgggcttgaaggtcaagacaaggatctaacattgcggctgaacggatatgctccgctgaagactgcagcaattgatcggcgataagggcgcccatgccttctgcgagcaagtgtattttcggattgaggatttcttgtttcagcacataatgaatcagctgtctggcgtaaaggacggctttttccgaaccccaatgccgtccgtataaattgctgttaaaaatggtgtatcctctgtcaagcatcgtatttaacagctggtttctcccttcatgttcgagccaaaagcttgagtcccggctgacaaagtgggttctgtcccccagaataaagatacagaagccattcggccgatacggcagatggatgacgttcagctcagatccgaattggaaaaatctttccgtaatccccatgcctgcccgcctccttttactcctaatctctctattggctatcatatgtaagaagaatgaaaacggatcggataaactcctatttgctgctatgttttggctattatcccgagcacaggaaccgaattttccatcagacggccggacaggcgggcaaatgtcagtttcaggcgcgctttttgatgagaaaatgaccttccgcccgcgctttatgtatggtatgatacaacgtagaataaaatgaaggacgaggtggaaacgtgcggtttattatcggttttatttggacgttccttttaacacatatggcctgttatttggtcgcctccatgaacagcgcggcgtacaatttcaagcaatcatccgttattgccgtggttattgcggtgctagtctttgttcttgcggagatcatgcctgtcaaacaggatgcaagccagcattaaataaaaaaacctgctattcagcaggtttttttgtgttcacggttttcgttgatacgtccacaatctgttgtggtttgaagtttcagggaacatttcccccaccgtaagcttgattttttgcgggtttttgaccatgcttcccgtttcgccgatttcaacgtacacaccgttattcggcgctttttgtcccgggcggaattgatgctgctgtcccacgtcatttcctcctttttcttttttatgtagtatgcgcttgtatgcggagaaatatcaaaaaccgctgaatgagattcagcggtttttttgttcatcctgtttgtaaagaagagctttcaggagcgctttttgcgcgtgaagccggttttccgcctgctgaaataccgcagagttcggaccgtcgataatctcggacgtgacctcttcttcccgatgcgcgggcaggcaatgcaaaaatgtatagtcgggttttgcgagactgacgagtgaggcgttgacttgatacggggcaaacacattcagccgctgctgcgtctcttcctcctgccccatgctcgtgaagacgtcggagtaaatcacatctgcatcccgcaccgcttcctgcggattttcggtaagggtgattttcgctccggaaacagccgccgcttctttcgcggcattcaccgcctcttcctctacttcatagcctttcggcgaagcaatcgcaatgtcacagcccatttttgcgcagccgatcataagtgaatgcgccacattatttccgtcaccgatataggcggcttttactcctttcagttttccttttatttcttgtatcgttaacagatccgcgagtgcctgacacgggtgataccggtcggtcagcccgtttatgacgggaatgtctgcatgctcggcaagctcttcgactttttcatgctcaaaggtgcggatcataatggcatcaacgaagccggacatcaccttcgccgtatccgcgaccgtctccccccgcccaagctgcaggtcgctgcttgaaagaaatagtcccgttcccccgagctgggccattcccgcttcaaaagacacacgtgtgcgggttgaagatttttcaaaaatcatcgccaatgttttcccttggaaaatcggctgtatcggatgttgttttaataatgaagcttctgtcagaagcgctttgatgtctgacgggctgacatcttttaaggaaagaaaatctttgccgtacaaatgggttaatgtgtgttccgcttttattgtgtgcatgatgccacttccttttgataaagatctttgagcgatacaggctcaggtttgccggagccgcttgctaaaaatgcctttacggtttccggttcagtaaagaccgtcacaccatgcgtcatggcttcgatccgttgtttacgcgcttcttcagagtgattgaaattgatatggaccgctttatcctttcgctctgcccatgccgggaacgcatctttgcataccgtaaatcccgcctcttgagcctgacgttccaattccgcatcacagccttccagatagatgctgccttttttcacccagacgtgcgcgtagatttttttcagggcgctttctgcgtcaaacgcgacacacatgccttctccggtcgacttcatttccggcccgggctttacgtccacatcctgaatggcgtgcgaagaaaaaaccgggaatttcactgccgttccgtgctgattttgaacctcgggcttgatgtctttaagggaagcgccggccagcaatctggcggcaagcgggatcatcggcacccccatcaccttagacacgacaggaaccgtgcggcttgcccgcggattcacttcaagaacgagaatatcccctttgtcatcaatgacaaactgaatgttcatgatgcctttaaaagccagttttaccgcgattttttcggcggcctcttttatattccgctgcatatcaggtgtgacagacggacccggaagaatcgcaaaactgtcgcccgaatggacgccggcgcgttcaatgtgctctgtgtaagtcggcacgaatacttcatgtccgtcggaaatcagatcgatctccaattcttttcctgtaatgtactgatcgatcaaaatcggatacggcatgcccgcttcatttgccagcagctctgacatttgcgcttctgaatcaacgatgatcatgcccatcccaccgatgacataagacggacggatcagcacggggtagccgattcggcttgctttttccgttgcttcttcttttgaataagcggtttcgcctttggcatgtttcaggtcaaggtcatcaagcagctgataaaacagatcccgatcctccagcgcatcaagggtttcaaaggatgttccgagcagcggaatgcccgctttttccagcggttcagcggcattgatcgcggtctgccccccaaactggacgatggcaaaatcaatgttttcatgttccgccacgttcaaaatatgttctgtcgtcagcggttcaaaataaagccggtcagcgatttcataatccgtgcttactgtttccggattgttattgatcataatcgtttcataccccagcttttgcagggtcagaacgccgtggacggcactgtaatcaaattccactccctgaccgatgcggatcgggcctgagccgatgatgagggcgcgttttttctcttttcggctgatatctccgtcgctttccccgaggtaggtggagtagaaataattcgtcttggcatcaaattcagcggcgcatgtatctacgattttaaacgacgggacgatgcctgatttctttctgagagcacggatgtcttcttccgtttttcccgtgagagatgcgatcatgacatccgtgaagccttttaccttcgcctgctttaaaagcggcattgacagatgatccccttcttccatcagcttgttttccaatgtgatgatatttcggaatacatggagaaaaaacgggtcaattttcgttttggcatggatgtcttctatcgtttcaccgcggcttaacagttccatgacgacgaaaaatctccggtcatccggcgttaccgctaattcccacagctgattgatcgtacagccgccgagttcaggcaggcgggtgccgatcgttttcagctcaagggaggccgccgctttttgaatggccgcttccatatttctttcaatcgccatgacctctcccgtcgctttcatcttcgttccgagcgtgcggtcggcatgtttaaatttatcaaacggccagcgcgggaatttgacgatgacataatcaagcgccggttcaaagcttgcataagtagagcccgtcagcggatttttcagttcatcaagcgtatagccgacggcaagtttcgccgccattttggcaatcggatagccggtcgcttttgacgcgagagctgaagagcggctgacacgcgggttcacttcaatgacatagtactgtttgctgaacggatccagcgcaaattgaatgttgcagccgccgaccacatccagcgccgaaataatcgccaggcttgctgaacgcagcatctgatattcttcatccgttaacgtctgggacggtgcgacgacaatggagtcccctgtatgcacgccgacgggatcgatgttttccatattacagacggtgatgcatgtatgattgctgtcgcgcatgacctcatattcgatttctttaaaaccggcgatgcttttttcgacgaggcattggctgatcgggcttgctaacagcgcctgtttaataagcgtctgaaacgcttctttcgttttcgcgattccgcctccctttccgcctaacgtgtacgccggtctcagaatgaccggcaatccgatagactcagcgaaacggagggcgtcttcttcgttgtcgacgatttcgctttccggaacgggctgatcgagctctttcatcagggcgcggaactgctcccggtcttcgcctttttgaatggtttccaccgatgttcccaaaagcttgacgtgatgcttcttcagcacgcctgcttcttcaagcttaacggctaaattcaatgccgtctggccgcccaaattggcaagcagaccgtctggtttttctttttcaataatggcctcgatgctgtcggttgtgagcggttcaaaatatatttcatcggcaaacgcctcatccgtcataatcgttgccgggttgttgttgactagaataacgcggtatccttcttctttcagagccatgcagccctgcgttcctgaataatcaaattctgccgcctggccgatgatgatcgggccggagccgatgactaatatgctggaaatggttgtatctttaggcatgagcgatttctctccttgctggtatcactttctctagaaattcatcaaatatccactcgctctcagccggtccgggatgagcttcagggtggaactggacgcttaatacgggaaggcgcttatgaatgagcccttccactgatgtatcattgacatgatgaaatctgatggacagctcgttttcgtcaattgatgcttcatcaacgacatagctgtggttctggcttgtcataaacacccgtttcgttttccggtcaatgacgggatggttggcacccctgtggccgaacggcagcttatacgtatttcctccgaaagccagggcaatcagctgatgcccgaggcaaataccgagtgcggggaaatcactgagtaatgatgtaatccggttcatgtacggcgcaatcgctttcgggtcgcccgggccgtttgagagcacgattccgtcaggctgaatgtcgtaaacagcgttcatctgctgatacggaatgaccgttactttacagccgcgctttacaagtgacgaggcgattgattttttataaccgaaatcaatcagcgcaatatgccggtctccattccccattgacgtgatgtcttcagactgcgccagctccgccgggttttctgttccggatgctgccggaatttctcctgttgttgacacggcagcgttcatcgtgccgccggagcggatggttttgacgacggcccgtgtgtccacttcggttaagagcgggatgttccatttatttaaatactctctcaagcttgagactgcttcatggtgagaaaaatgttcacacgcttcatagacggcaacagccttgacttgaggaatcttactttcaaggtctttttcattaattccgtagtttccgatcagcggatacgtaaagacgacgatctgacccttatatgacgggtctgtaagcacttcctgataacccgtcattccggtgaaaaaaaccgcttcgccaacacagcgggcttctttttcaagttcaccgccgaatgatgttccgtcttccaatactaaatagcctttcatctaaagcccacctcttgatgaataattaattaaaaatatgaatttttatacttttatatcgaaaaaaaattaccgtttcactgccgaatgcgcttcgatcgctgctttcagcatactgacggccgacagcatttcttcttcagaaaccgtaagcggcgggagcagcctgatgacattcggtccggccggaagcacgagaagcccgcgttcctgcagatctccgatgatgccggacacgggacctgcgcattcaatgccgattaataacccttttccgcggatttcttttacaaaaggccctgtcagttcacggttcagctgcgcttttaaaaatgatcctttgtctgccgccgcctggagaaagtccggctgaaacacaatgtccaaggttgctttcacagctgccatggcaagcttattgccgccgaaagtcgtaccatgcgtacccggcgtaaaggcgtcgccaagcttctttttgccgatcacggctccgacgggaaaaccgtttccaagccctttcgcagcagtgatgatgtccggcgagatgccgaaatgctcatagccgaatgccttgcccgtccggccgattccggtttgaatctcgtctgcgataagcagcgcctgtttgtctttgcaaaatgtctgtaaggcttcgatgaattccggatcggcgggattgactcccccttctccctgcaccgtctcaagcatgacggcggcgatatcatcctcttttgaaagcgtgctgaatgccgacggatcattgaacggaagatagtgaaagccttgaagcatcggtccgaaaccggtcttgattttgtcttgtccggtggcggccatccccgcataggtccgcccgtgaaaggattgatgaaatgttacaatttttgtctttcccgttgctttacgggcaagcttaatggcgccttcattcgcttcggccccgctgttgcagaagaaaacgagatcccccgcgctatgttcggcaagctttgccgcggctttttcctgaagatcattttcaaacagattggaaacgtgccatacgctgtcaagctgttctttcaccgcttctgtgacctcatcatgacaatggccgagattggaaacggcgatgccctgaataaaatcgagatacgtttttccgttttcatcctctgcaattgtccctttcgcttttttgatatcgatgggccagcgactgtaggtttgaaatagactgctcatgacacgctctccttttctttgacaatttttgttccttggaaggcttgatcggtgaaaaacgctccttttccgtttacgatcatcacttcctcgacatcttcactcagtgccgataatgccgagtttaccttcggaatcatccctcctgaaatcacgccgtcatctatgagggcctgaatctcttgcggcgtcaaagtatccagcctgctctctccgtccataattccttcgacatccgtgacaaataaaagtttgtcggcgtgtaaggctgaagcgacggccgatgccgcggcgtctgcgttgacgttcagcgtttcgaaatcacttgtcatggaaagcggagcgataacgggaatgatgccttctttcattaatgcgtgaatgattgacggatcggttttttgtatttcgccgacttctccgtatttgtcttgattaagataggatgcttgaaggagaccgccgtcctttcctgatattcccgcggctttcagcccgtttttcgcgagttcggttacgaaaaatttattgatcgtccctgacaagaccatttccgctgtttccagcaccggtttggtcgttttccgctgtccatcgacaaattccgtttcaatctgcaatgttttcagcatttttgaaatgtccgggccgcctccatggacgacggcaatgttccagcccgattgcataagctcttttacattttgaaaaaaatcggcggataactcgcggattacgctgccgccgcacttaaaaacgatcgttttcttcatgccgctcccctttgttatgtgcgatagctcgcattgattttgatataatcataggttaagtcacagccccatgcccggccgctgccggagccttcctgcaggcggactgcaatcgtaatctcatcacctgataagtactccttggcatcagtttccgaaaacggctgaggttcgttgtgtttaaacagacactggccgccgaggaaaacttccacttgttcggccgttacgcttgccgcactgtgcccgattgcgccgatgatgcgcccccagttggcgtctgtgccgtaaacggcggtcttcacaaggcttgagccgacgatttttttggcaataatattcgcctcaaggttatttttcgcgccttcgactctggcttcaattaatttcgtcgctccttcaccgtctctggctatatctttggcaaggtcttcgcatacaagctttaatccctttttaaaagccggccagtcagggtgctgctccgtcaggcaatcattccccgcgcagccgtttgccatcacaagcaccatgtcattcgtcgatgtttctccgtcaacggtgatttggttaaatgaaacatccgtaatctctctgagcgcgtttttgagcgcctgttcttccacggccgcgtccgttgtgacaaagccgagcattgtcgccatgttggggtggatcatgccggagcctttcgccgctccgccgatcgtgatgatgtctccgccgatcaccagttcataacacgtctgtttcgtcactgtatccgtcgtcaaaatggcttcttcaaatgctccggacatggatggcgcttgaccgagctgttcaatgcccgcttgaatttttttcatgtctaaaagctcgccgatcaccccggttgacgaaaccgcaacaagctccggctcaatgccgagctggctcgcgaagccgtcccgcatttcataggcgtcctttaatccttggtctcccgtacaggcgttggcaatcgcgctgttgacgataaccgcctgaagcataccctcttttttcaggctggcttgcgtcactttcagcggcgctgcctgaaaatggctctgcgtatataccgctgcactgactgcaggcgcttcgctgataatcgctccgagatctttttttgaatagcgcagaccgcaatgcacgccctttgcctcaaaccctttcggcgaggatacgccgccttttattttcgtgatttcctcactcagctgaatcatatttttgaatccctctttcgttctatggatagactggcgtcatcgtaagtcccgtttcttcctgccagccattcatgatatttaaattttgaaccgcctgccctgcggcgcctttcatcagattatctatgacagaaacgatggtggcacggtttgttctttcatccacggtgacactgatatcacaaaaattgctgccgtatacctctttcgtcgccggaaattcaccttccggcctgattctgacaaaatatgaatctttgtagaattcggaatacaattctcttacctgtgcagcagacatacccgggggagcctccgtatacatcgtcgccataatgccccttgtcatcggcgccaaatgtgcggaaaacgtgatcgggcctgtgccgggctgccaagccgctaattgctgttcaatttccggagtatgctgatgctcattaaccttataaattttgaaattatcattcagctcagaataatgagtgcccatggatgcttttcggccggcgccggatacgcccgttttcgcatcaacaatcagaaatgaatcttgtaaaagcttattcttcgccagcggggcgagcccgagcagcacagccgtcggaaaacatcccggattggcaatcagctttgcagtctgaatctcttctttttgcagttcagctaaaccgtaaaccgcgctttgaatcgttcctttcggagcggccttccgcttataccacttttcatacacggccgggttttgaatccgcagatcgccggatagatcaatgaccggaatgcccgcctccgccagcttgggcgaccactctccggaaacgccgggcggcgcggctataaacatgacatcaatttcgtttcggatcgtttctatatgaagcggccgaagtgattgtgacgctatattcctcaaatgcggatatgaagcggcatattcttttccttcgtcgctcgatgaatataatatacaatcttctgcataagggtgatggttaagaatcctgacaagttcggcgcctccataaccagtcgcgcctataatacctattttcaacgggttcaccttcttggtttttgtgaaattatttaacattataacatgaataaaaattaattcaattgtatatttaatattttttcattcattttccatctgttttcgctgacaaaaacccccctctcgatcgagggggcataagaaaaacaggctgatcggatcagcctgtttttttcagcatcatcagcccgcttataaaaaacagcacggagctggcgtaaaaaataatataaaccgtaaagaaatcagcgagaaacccgccgagaataatggcggcagctgaaaatacggccgtccagaaatgatagctgccgactttttttccccgctccccgccgtcggtgtaatcggcgatcatgattttctcgccgtgtttttgcatcgcgccgaacaggcccaaaagcacctgcacaacataaacctggtgcacgccggtaatgtgcgggagcgtcagaagaagcaccgccatcccccacgaatttgccataaggaaccagcgggaatccagtcttgccgacagccggccgagcagcggatgaatcaatgcgccgctcaagccgaacaagccgtatgagagaccgaattgcgtgtagctggaaccgatgtttttaataaataaaatataaaacggaaagatcaggctgccggcaaaaaagacactgctctgtgacaggatcagccattttaaatggttgtgtttcatgatttgtacctctgataaaaataattcataaacaagtcatccggatcatatttgtgttttttctgaaagaacatatcgcttttcggatatgcctcacgcatctgctctttcgtttgatacagcatatacgggagataataactgccgcggtggcgcaatgccgtatccgtcatttttctgacaatccgcgccgcactcgcctggctgtctgttgaaaacccttcattgattaaaagaacgagtgaaaacatgtcttcctttgcgtatgacagatcggctttttcatttttttgcacgtagcggatcgtaatatttacgaggttgagatcttcatgtgacagcgtcttgcgtaaatcatgaatgtacggcgcaaattcgccgacgggcacgaagtattcttgcagcacatcggtgttgtccgtgttttcatattccaaaaatttcgattctgaccgcatgacattgttcctggagactttcacaccgttttgtctgagaaaataagactgctgggttgaccagaaccaatttcttccccagtcataccggcgggagaggccgagcgcgaatttcgtcagcgccggatgctcatcttctttcagttcattgtgccgctttaattctttctgattgtctgagagtgtgtaatcagtcacatacatatcgtgcaaaaagcctttatcccctgttgcgatccgcgcgagatgcatgcgcacggcggggttgcgccgaacatgctgcgcaaaatattgactgtatgtatcagcgttcatgcgtttcgttttcatttcataaagctcatcatccgtcagctcaatatccgcgtccaggatgacgccgaacaggccgtagccgccgatgacggctgaaaacaggtcatctttcggagtaacggtgatgactttgccgtccgcctttaaaagatgaaacgatttgaccgtatcaatcagcgaaccgtaccggatatcccggccgtgggcgttggcgctcagtgagccgccgatcgtaaaaatgttttgcgattgcatgacttttaccgcgagcccgtacggattgacatagcgctgaatatcattccacgtcgctcccgcctgcaccctgatgatttttttctttcggtcgagaccgagtattttgttgtagcccgtcatgtcgagaacgataccgtcttcataatacgtctggccgcccattgagtgctgggcgcctgcgattgagatcttcaggtgctttctcttggcttccttaatcgtttcgaccaatgtttctttctcttttcctttgaccgtctgcttaattttcacgggcatgagacggctgacatccgtcattgtccctgcctgctgctccggctctttgtgaaaagcggaaacagcgaacagcgccgtataaacaaggatgctaaggataatgagaagtaattttttcttcatggattcctccctcgcatgcagccggtctattatatcatgcctcacgtccgtttttttcctttttaacccgatacaggaaaacaccgggtataaaaatccacagaaatccttaaaatgattttttagtcagtatataatcgatatatatgcagatgtattaccaaagggattgtttaaaacaaacatgttaaatgaggtggggaaaataaacataaaaggaatcaatcatcttcttttttctgtttcaaatttggaaaaatctatagaattttatgaaaaagtatttcatgcacagctcctggttaaaggacaaaagacagcatattttgatctgaacgggctttggcttgcacttaacttagaggcggatataccaagaaatgaaatacataaatcttatacgcatatggcctttacaattgacccaaaagattttgatgcaatacatcaaaggctaaaaaatctaaatgtaagtatattaaatgggcgtcctagggataagcaagatcaaaagtcaatttattttactgatcccgatggacataaatttgaattccacacaggtacactccaagacagactgtcctattacaaaaaagataaacctcatatgaaattttatatttaaaggtttgtttgcgatccaaaacaaaccctcactgtcgcttatccgcgttgattttttccttgtaaatgcagacaaaagaaaagcacctccaaactttaggatgtacctaaaatccgaggtgcattttcttattactgaatccctaatgcgatttttgcgtagcgtgacattttgtctcttgtccaaggcggattccagacgatgtggacctccgtctcttttacatccggaatgtcggcgagcgcttttttcacctcgtcgacgatgatcggagcgagcgggcaccccattgatgtcagtgtcatcgtaacgtgcgtcaggccgtcgtcatccatatcaacgtcgtatacaaggccgagattgacgatatcgacgccgagctcagggtcaacaacctgctccaaggcgcccatgatgttttcttttaatgcttcttccacgttccatcactcctttttcctcagtataacgtaaaagcggcttttgttaacacctttgtgctttataaatgcttatcgaaccaggcgacggtttctaaaacggcgtatctcgggactttatgatcagcccgttcgtctttcagaaactgaagatggtcgggccggctgctgtaatgaggtttaatcgtttcataaaagccgcgggtcggtgcatacggaacgactttgtcttgaacgccgtgccagaacagcagcgggcggctgcggagtttttccggttccagactgagatcgaacggtttgagccgcgcaaacagttcatcgacctgttcttttgtgacgtcaatgtcgatgtcctgcttttgaatgtggtcaatctgctgctgaaaaaatgccgtatagttcgggcttcccatcagactgacgccggctttgacccaatcatacgcggccatcgcgccgaatgtcgtaattccgcccattgacgtgcccgcaagaccgatccgcccgtcttcaatcagaccgcgcgcttcaaaatcctttttcagcacgtcaagctcctcgatttcatttaatacaatgtcccaaaaatggacggcgagctcttctgctgacagctgttcagcgcgttcaccgtggtaaagagcttccggcagcacggccctgaagcccttttcagcaagcaggtaagcgaaatgaagattatgctccttcgcgcttgtaaaaccgtgaataaagaaaacaaggggagcgggacggtcccgattttcttcttttacaatatgtaaaaacggaatgcctgatacggtttgatgatcaataagaatcacgttgactccctccttaggataaccataatcataagtgtaacatgtagacaataaagatggtaaaaagctacactgtacataagtgaaaaacagcaaattatatgacaaaaggagttatttatggagacaaaaccttatctcatcgccttagatctggatggaactttattaaaagacgataaaaccatttcccctgaaacggcacggacgattcagaagctgaaagaagcgggccatcatgtctgcatctcaaccgggcgcccgttccgttccagttcgatgtattatgacgagcttgggctgacaacgccgattgtcaattttaacggggcgtttgtccaccatccgaaagacgaatcatggggacgataccacacgtctttatcggtcgatgtggtcagacagcttgccgaacttacagagacctatcaaatacataatgtgctcgctgaggtcattgatgatgtgtacttccattatcatgatgagcatttaattgaggcgtttcatatgaatacggcgaatgtcacattcggcgatctgcgtgaaacggtcaaggaggatgtaacgtccgtattgattcatgcaaaggaagaggacgtcgcggatatacgcgcacatttatccgatgtgcacgccgaggtcattgaccacagaagatgggcggctccgtggcatgtgattgaaatcattaaacacgggatgaataaagcggtcggcctgaagaaaatcagcgactattaccaagtgccgagagaacggatcatcgcgttcggcgacgaagacaacgatcttgaaatgctccggtttgccgggtgcggcgtagcgatgggaaacggcacggatgaagtcaaacaggccgccgaccgcgtcacgggatcaaatgaagcggacggaatcgccgaatttttaaaatcctatttctccctgtgaggttttgccgctcataacacaaagccttccgcccatactaaaacagacgactcatctcgtctaaatatggaagggggacattgcaatgggtaaacgaaacaaatcaaaacggtttattcagcaaggcaaggactctgtcagtcttcatgacgcaagatttccatatcggtctacattagaggaagcacagcatgatgcagcaaaagattcggctgaaaggcaggttgacttttaatgagaaacgaactgttttctcaagccaagtcatttgtccagcaggccgtcatgattgctaacggtttcgaggacggcgatcaggaaaaagctgtctcacgcgccaaaaacgccgtgtcttccgcgtacgccaattcgacggatgcagaacgtcagcagctgcaccaatttcaggatcagctggagaaattgcaataaaaaaaggcgccccgtttagacgagggcgccgcttttttattttacttcaaatgtttttaccgttttcagtctttttccgatctgatcggacttccctaaaaacgtcaccgtcaccgtgtatgttcccggaccgggcacgttcttccacacatctgaaaagtcatacgtttcattcggcattaaggtcacggtctgaaacgcctgagtaaacattttgtcttttgaatagcggtacagttctttgtgatgttggtcatgtacggtcaattcgaatttctgccctgagctgaatgtgaaatcgatcgggctgccgctcttgttttttaaagacatttgaaattcgatctgctgatccgtctgcacagggtttacggctaattccgcttgctgttcattcatctctccggatacctcctcagcgggctccttctgcccggattgactgctgcatccgatcagtaaaatgaccggtaataacaggccaaacagccacttcattctatccgctcctatcagtcttttctgaagaaaccaaagatccccgtcgtttgcacgatgtttgtgaaggctttcgggtcgacttctttcacgattttctcaaggtcatacaattcgtaccgcgtgatgacgatgatcatcatttctttctgttcgtttgtgtaagcgccttttgccggcaccgtcgtaatgccgcggaccattttcccgtaaatcgcttctttgatttcatcggctttttttgtaacgatcatggcggtcagtttcatgtggcgggtgtgaatggcgtcaatcacccttgttgtgacatacagagcgacaagggtatataatgctttctcccatccttgcaataatcctgccgtcaaaatgataatcccgttcaaaatgaagaaatatgtgccgaccggcttatccttccatttggccagcaccatcgacacgatatcaagaccgcctgtcgaagcgccgaatttcagcgttaaaccgatgccgatagctgagatgactcctccgaatacggtattcagaagaatatcgtgcgacagtctcatttccgggagaattcccataaagacggacgtcagcgctacgcttaatatgctgtatacagtgaatgatctgccgactttcagccaccctaacacaccgatgggaatgtttaagaggaacatgagaactcctgtcgaaatataaaagggggcgtattgatcaacgacgcttgacagcagctgggcgacaccggtaaaaccgctggcatatacattcgccggtatcaggaataaattcagtcccgccgcatacagaaacgcgccgatgacgacgattgctaatttttttgcttgttctagtaccatggcttgctcctccgctcattttcattattagcttttcccttaaaataaagttttgaacactattttgccacatttatatgatatagttggcatcactctcaccaatcggaaagaagggaattatgatgacagttcaccttattgctgacagcgcctctgacctgccgaaatcttatattgaagaaaaccggatcgggttcattccgctgcacgtaacacttgacggaaacgaatatgaggacacggtcaccattcaggcggatcatatatttcaagcgatgcgggacgggaaagttccgaaaacatcccaggcatcaccggatacgataaaaaaagtatttttacaatacgcggaactgggagacccggcgatatacatcgccttttcctcaggtctttccggcacctatcagacggccgtaatgatcgccaatgaagtaaaagaggaatttcccgattttgatttacggattgtagattccaaatgcgcttcattgggctgcggcctcgcggtgatgcacgcgcaaacactctgtgttaacgggaatacaatacaagaaatcgaaacgtctgtaaagagcttttgcgcacggatgaaacatatatttacggtcgatgatgtcgcttatctcgcgcggggcggcagaatttcaaaaacgtccgcttttgtcggggggcttttgaacatcaaaccgattctgcatgtggatgacggcaggctcgtgccgctcgaaaaattgcgcggacagaagaaactgtttaaacggattatagacatgatgaaggaagaaggcggcgattgggcggatcaaaccgtggggatcagctatgcagataacgaggagacggcgcttcggatgaaggaaatgattgaagaagcgttccatccgaaagagaccattcttcattcaatcggctctgcgatcggcgcgcactccgggccgggcacgctcgcgatttttttcctgaagccataatttcaatgcgggcgggcatcctaacggacagaagggaggctttgccgcatgaaagatgatgacaaaaaaccgttggacaataacgccgtaaatcagaaaaagaaccggcttgccgaaaaaaaccggcaggcgggaaaaaaccagaattccaaaaaaccggaccatctgtaaaagcaaaacagccctcttgtggatgaagatagagggctgttttttgttctatatgcgtctaacatcacttatcacgaatccgctttcaggcaatgccggcattctggacaggctgaagctcaaatcttgggacggaacatcgtactctatttcattggcaagaaacgcaagggaagttttcatgacttccacggtcattccctcacccggacagcggtggccgttagccggatcacctccgccctggggaatgaaatcaaatttattttcctcccgcccctgaaaacgttccgggcgaaattcattcggattctcccaaagccgggaatcatggtttgtcccatataggtcaagcatgacggatgcaccttttttaaactcacagttcttccatacgaaatcttttttcacaacggctcctaaaaacggggcaaacgggtaataccgccgaacttcatgtacaaatctttcggcctcctgatcatctctcgatctcagtttaccccgatattcagggtaatcatgcaatgcaagagctgaaaacgtaatgaagtaagaaatggcggcaatcgggcgcagaacattaataagctcaacagcagccatgtgagaatcaagtctgttcccgtcaagttctgtatgaaaagccatttcatacaaggctgagccctccggcgtttgcagcttgccggaccgcacatcctcaatgacctcctctatccatttctccgttttcagcctcgcccttctgcctttccaatgacgcggtccgacagcgccgaatgcgtctaccatatcggtgaaatcctccgcccgctctttcacttctgagtctttcagcgggacgccggcccactcacaggcagcccggcacagcactttcttcgcttcatcaaaaaggacaattcggtttgaaccctcccacatttccgcagatgctttccactgttttgccaccgcttccgcaagccgtttttgccggggcggcgtcatcagcgacataaatagaagcttcctgtgcttatgccgttcaccgtccattgactggattgcccctgttccgaataacgttttctgcacccgtttggggagggcatgctcccgctgaaatcgttctgtgtcataaaaaagctttgcggcttccgctccgctcatacaaatgaatgtcttccctaataaacgggcgcgaaacacatccgagcgataattctccgctctgtttttcacaaatacatatccatcgcgtaataaagccagactattatcaagacccttatcatgcggaatttgttcattcatcccgattcctcccatcttttttcacctttcacgaaaaagaataaatataaacacaagtatattcagtatttgtgtttcattcagaagttactcatgtcaggctgcaaaaatcagggggcggggcataagcccgttacaaagtaaaccggcggacctgatcgtttaaccgctctgtcaggctcaccagattatcgacgctttccgccattttatgaaaagaagacagctgctcaagcgcggaggcagaaatttcttcgcttcccgcagccgtttcctgaacgacggcactgatgctttcggcatgatgcagcacttgctcaccaagctgtttcgattcgatgatccgtccgtccaattgagtaagctccgctttaatatgggcggctttttgttcaatatggacgaatgattctgacgttttctccatcagctcctgctgtctgtccgctaaagcgacgccggtcgtgacagctccggtaatagatgtgatgccgtcttcaatttgctttaccatatcgaaaatctgcgcggtcgctttggctgatccgtctgcgagcttccgtatctcctcggcaacgacggcaaatccttttccggcctcgcctgctctggccgcctcgattgcggcgtttaatgacagcagattggtctggcccgcaatgtcagaaacggtctgcgccatcatactgatgcctgccgcatgctctatgaagagatcggcggcttcggaaatctcttttgatgtctcattgcttttatcaatggcttgcttggtctcggctaaagcaccgcgccccgcagccaccgccgcaatcgtctcttcgctgcttctcgtcgtttgttttgaacgttcggcgttcgcctttgaatgttcatccatttgttcaatgaattgcaccgcatgctgcagatcttctgaaatggtttgggagccttgcgccatttcttccgtcgacacggatacctgctcggtcatgtccttcagcgtctggttttccttcgtcaaaccttccgcgaaagtctcgacttcacggccgacctctccgatcgcctgaattaaggtgcggagctgttcagccatcattccgaatgagtcattcagctctttcagttcgtccttccctttataatcaagcatttcaacagcaaggttccctcctgcaatacgacgggcattttcagccatgcggcggatcggccctgcaattctcttcgtcagcctgatggaagatatgacggtgacggcaagtatcacgatggtcagcacggctgcgctgtaaacgataaactgaatctggtcagccgtctgcttctgcatgtcttcatagtgatcccggcttttcagattcagcatataaatatcattcagaagaccgttgatgcgggccgccgtccttgtcgcttcagccgggcttttcgaatcaagagcagcgtccgcctccgcctgccatgattcgtattttttggcgagtttgtcataagcggctttgtctgcaccgtccgtcatcgtttttttgagcgccgccagtttgtctgagctgcttttcatatagcttcgcacatcttctttctgggcgtctgcgagcgtataggaatagccggtgatgctttcttttaacgtattaaggtcagcttttgcttcctgaacgtttaacagcgcgtccacttcatcttcatttgaagcctgaatcttcatcatgtttacgatggtaaagccgatgacggcggcgaagcaaatcatcgtaacggctgcgttaacgagcagccttgtccgtaatgtcacttcagatcgcctcctgtttcaatcagactgtttttcatatccgtgatctttttcgtcagcccgcctgcgtttttgacaactctgatcttagctaagtccatgccgttttccttcagtccgtaaacgatctcaccgcttttgatctccttgttgtcttttaaatctttcgccaattcatagatgacatggtcgacgtttttcactaaagaagagataacggcgtgctcggcggtgtaatattgatcgctgtcaacaccgatggcgtatactttttgcgcctccgcttctttcagtgcgccgacacccgtgaagccggccgccgtaaacaggacatcggctttttttcggatcatgttttgggcgatgcccttcccgagcttatcatcatcaaacgtaccgctgatgtccgacagcacgcggattctcggtttgactgattccgccccttgcagatagccttttttaaaccgtttaatgacgtcggcatctgaaccgccgataaatccgattgtgccggttttgctcgtcatggccgccagcgctccggctaagaagcttccttcatcctctttaaacgtgacggaggtgacattatccaggtctgatacggaatcaatcagcacaaaccgctgcttcggatattttttggcgaccttttctaaatccgcctgcatgctgtaaccgagccccaccacaagatcattgccttccctgacaagctgtgtcagtcctttttcgtatgtaccggtatcttttatttccctatagtcaaatgtgatgccgagctcgtctctcgctttcatcaaaccttgaaagcctgaatcattaaatgattggtcgccgaggccgttgtctgtcagcatgatgccgattgttttcgttttttcggccgccgtttcctcagatttgccggcacatcccgccgtgctgagcgcaatcagcagtacagccgcaaatatcgccatttttctcattgaaactctccttttgtttttttctatagttatatatcggttcggatgtcagaatattttatttcaataaaatatgtatgttcggcaggatgttaaacaaatgagggcataggagcttttgagaaaataaaaaacatcggttttggttcaccgatgtttttgcagaaaatttattgtttttcgtatgtccagccgtcttcctgatagaccttgccgtttttcatcagatgcccgagcgcccgcttaaaggcggctttgcttaaatgaaaccgttcgcggatatcgtcaggatggcttttgtctccgtaaggcatcgcgccgtttcttgatctcagataggtcagaatttcttccgcgtcaaccgaaagcgcatcctgctttctcggcagcagggacatgttgacggagccgtcttccttcacctcgatgacacgtcctgtcacgcggctgccgagtctcggctcttcttttctttctgaagggtgaataaacgcgcggatgccttcatcggtaatcagaaaagagcctgatgcaatcagtctgtacaccgtgcccgtcaggtctttattcatgacgtcttcccctgcatccgtaaataattcactgatgatatcctcaggcgccggcttggcaaacatgcgcccgcggcttgtcaccttcagcatgcaatacagtctgtctcctttttgcggccagacggatttgtacggaggcaggtgctccgttgcgacgagcgcgtcttttgacagaccgacgtcgacgaatacgcccatatcttccacagcgtccgtcacttccacccatccgtagtcataaaagctgatgagcggctttttcatcgtcgccgcgagtctttcctgatgatcgacgtaaataaatacgtccacttcatctctgtcttcgatatcctctgtgatttcactgttatgtaaaagaaccgtatcctcgccgtcggttaaaaaataaccgaaatcggtttggtgatctatactaagcgtgagctgctgccctggtctcatgttatcgtccttcctgattcgcccgtatgaggctgatgtttttctcattttttccaatatgcataaattcatgctttatgctgttggacatttctctttattctactataatcaactcataagtgaaatgttataggaggttttctcatggcaaaagaaagttcttttgatattgtatccaaagttgaatttcccgaagtgcagaatgcgattcagatgacgctgaaagaaatcggcacgcgctatgactttaaaggatcgaaaagcgatgtaactttagaaaaggaagaacttgtcctgatttctgatgacgagtttaaactgaatcagctcaaagatgtgctgagcggcaagctgatcaaacgggacgtgccgacgaaaaacattgaatacggcaaaatcgaaaatgcatcgggaggcacggtgcgccagcgcgcgaagcttgtacagggcattgataaagacagcgccaaaaaaatcaacgcggtgattaaaaactccggcttgaaggtcaagtcgcagattcaggacgaccaagtgcgcgtcaccggaaaaaataaagatgatctgcagcagattattgcagccgtccgcggagcagacctgccgattgacgttcaatttattaattttagataaattatgtgattcctattgattattgtctctattttcggtaaatttggagaaagggattttcacagttaagttttggaaacccatgacaattacatgaacgttcttatcaagagaagccgagggactggcccgacgacgcttcagcaaccggtgtagtggtttacccaaaccatgaccaaggtgctaaatccagcaagctaaaaacagcttggaagataagaagagagacaaatgattacaaagtcttcttcttaagaagactttttttatttctcttttttccttgctgaatgtgacgaaggaggcaaacaatgggactattacaagacttaaaagaacggattttaatcggagacggcgcgatgggcactctcctctattcctacggcattgacagatgttttgaggaactgaacgtatcaaagcccgaagagatcaagcggatacataaggcttacgtggaagccggggcagacatcatccagacaaatacgtacggcgcgaattttattaagctctcaagatacggacttgaggacgaaacgaaaaaaatcaatcaggaggcggtcagaatcgcgcgcgcttcctcagacggcgcttatgtattgggaacgatgggcggcatccgcacctttaacaaaaacgcctacagcctggaggagattaaacgcagctttcgggagcagctttatttattgctgcacgaagagccggacggtctgcttctggaaacatactatgatttagaagaggcgcgtgaagtgctgaagatcgcgagaaaagaaacggaacttccgattatgctgaacgtatccatgcacgaacagggcgtactgcaggacggaacgccgcttcgggaagccctcaggtccattgccgatctcggcgctgacataacgggaatcaattgccggctcggcccgtaccacatgattgaagcgctcaccgaagtgccgattttccgtgacgcttatttatcggtctatccgaacagcagccttccgtctttagaagaaggccggcttgtttatgatacggacgatgcctatttccgggagagcgccgtacagttccgcactcagggcgcgcgcattatcggcggctgctgcggtacgacgccaaaccatatcagagccatggctgaagcggtccaaggactttctcccgtcactgataaagaagtgaaaatcagacgggaagaagaagtcatctcagtccgcaacgaacggaccgagccgggtttaaacgaaatcgccgctcaaaaacggtcaattatcgtagagcttgatccgccgaaaaaattgaattttgacaaatttctgcaagcggcggctgaattaaaagaaaccggcatagaagcgctgacgctcgccgacaattcattggcgacaccgcggatcagcaatgccgcctgcggttcattgctgaaagagcgccttgatatccgttctctcgttcacattacatgcagagaccgcaacatcatcggccttcagtcacatttaatggggctggatacgctcgggctcaccgacattttagccatcacgggtgatccttcaaaaatcggcgactttccgggggctacctccgtctatgatttaacgtcctttgacttgatcaggctgattaaacaattcaacgagggcatttctttatcagggaaaccgctcggcaagaaaacgaacttttccgtagccggagcatttaatccgaatgtccgccatctcgataaagcagtaaaacggctggagaaaaaaatcgagtgcggagctgactacttcgtgtcccagcctgtctactcggagcagcagctcattgacattcatcatgaaacgaagcatctcaaaacaccggtgtatatcggaatcatgccgttaacgagcagccgcaacgcagagttcatccatcatgaaatcccgggcattaagctgtcagacagcatccgcgaaaaaatggcgctcgccggcgaagacaagcggaagcagaaagccgaaggcctcgccatcgccaagtcgcttctcgacacggcgtgcgaactgtttaacggaatttatttaatcaccccgtttctccgttctgatttgacgtcagagcttgcagcttatattaagcaaaaggatgaaaagcgggctgatgtatatttgcattgacgcggaagaggccgcctgatatgacaggcggctttttcatggtacgatacagaaaaagaatcaagcaaaggaggattttttcatggttgaagtaaaacccatcaccgcagaagacacatacgcgatcagacacagcgtgctgcgcccccatcagacgattgaggattgtaaatatgatcaggacagcgtcaaaggagcctttcatctcggaggtttttacgacgggacattgatcagcatcgcttctttctacccgcagaaccagcaggctttacaggcagcgcccgcctatcagctgcgcggcatggcgacgcttgaggaataccggacgcaaaaagcgggaagcacgttaatcgcctatgcagaacgaaaactggcagatatgggggcggcgcttgtctggtgcaacgccagatgtcacgtaaagggatattacgaaaagctcggctggaaaagcacgggcagcccctttgacatacccggcatcggcccgcatgtgatcatgtataaagaactcgcctgaaacagacaaatgcccttggggacatgtctctaagggcattaccttgaatgtcacgcctgcttttatatacggtactattgacgccctcccgcttttttaataccctttgtacattacacaacagcaaggatggcaggcagaacgatatctgtcaattgccgttttcagctattaattcagaaaaggaagtatgagatgaatacgatccaaaaaccgaaaatcccgaaagaattgccggtgctttctttcacagaagcgcttcaggacgacctcataaaagaagtcgtcatagaaaacgccgtggtaaacagcaaactggacggcctgcgcgccgaaaaagtcattttcagaaacaccgtttttacggatgtctctttcagacatatggaatgtacggatgtcctgtttgacaaatgtgatgtctcaaacgctgatttcagcggaagcatcatccatagaacggcgtttcagcattcaaaacttctcggcttgaatctggcggattccgccatgcgtcatgtacggtttgaagactgcctcgcaaattacagctccttcagctattccaatatgaagcatgtccggtttgacacgtgcgctcttacagaaagcgagtggaatgatgccgttcttgaatacacagatcttgacgcctgtgatttgaacggtgcaaacttcatcggcacgtctctttttaatatggatatcagcacgtgcacatttgatcatctgcacgtctcacttgagaagctgaaaggatgccgcatctctccggcgcatgccgttacattcgcagaagcgctcggagccattgtgacgtgatcttttattaaacgaaacggcgggcgatgtccgctatcgtttgaatgcctttttccaagtccggtaaggatgcgtatgaataggaaagacgcaggctttgccggtcttcgggaagatagagagctcccggattgatcagcacgccggcctccaaggcacgggtgaaaagcgtctgaacggcgattgcttgatgaaaagtgacccaaatataaaagcccccctccggcacacgccactccgcaatatctcccgcgtatctttcaagagaacgcaatgccgcatctcttctgattttgagttcctttctgagacgcaaaaggcgcgcttcatagcggccgcttgacagccattgacatgccgcccattgagataaagcactggagccgtaatccgtctgcattttaatatcggcgagcctgtctgcaaccggctcaggggcgacgacccatccgatgcgcagacccgggcttacggtttttgacagcgtgccgatatacagcacattcccctcaccgtccatggattttaacggaggcggcggttctttatcgatccataaatcaccgtatgcgtcatcttcaatgacaggcaggcggtgatttcttgcgaggacgatgagttccttcctccgcttgagtgacatcaccgttcctgtcggattatggaatgacggaatggtgtacagcagccctgcttcgtattgccgccggtaagcaggaagatgatccgttttgattccgctcccatccatcggcactcccttaagcctgacgcccgctgattgaaacacacgcagggaatggagatacgacgggttttcagtcagcatgacagagtttggttttagcagcccgattgaaatgagctgaagcgcctgcagcgcgcctgagacgattacgatggatgccggggacgcgtgaattccctttgttttcaaatgttccgcgacgctttgccgaagctgaaggctgcccttcggttcttcatagccgagcgcaaaaatgttagttcccgcttcacggaacagttcggccatctcctgctcaggcagcagctcttgactcagttcacccgtccccagcctgatcagatccggacgcggctcgttttgattaatggcctgaaccaaggctgaattcggctgatgacttcccgatgtaacgtatgtgctccaatcaaggggcttagccgctgccatgatgctccacgtattgttgacgacctttgtgcctccccctctttttccttccagaagaccttgggcgattaactcatcaactgctgccgtcactgtgcttcggttgacctgaagctcctcggcgagctttctttgtgagggaattttcgtgccgatggtccattcgccatgaagtattttttcttttatatgctgttcgatctggagataaagcggtatgtgcgactcccgatccggacgccagctgttcatacgtcatccctccttctttatttattatacatttggctggttcaagtaccagccaaatggccggagacatcagcacacagtgcggctacaatgagatttagttgacgattggagggttttacgaaatgaatgccattcttcacggagtgatgctcgctttcggccttattttgccattgggcgcgcaaaacgtgtttatttttcagcagggagcctggcaaaaacatgtgtggcaggcatttcccgcagtgattgccgccgcggtatgcgatacgattctcatcagcgcggccgtcgcaggcgtgtcaatgattattgcagagattcccgtttttcagaccgtcatgcttataggcggctttttgtttctcagttttttaggctggcagacttggagaagcaaaccgcaggccgaacaggcgaaaaaaacggttttctcggcaaaaaaacaggcggtcacggccgccatggtatcccttttgaacccgcatgcgattttggataccgtcagtgtcatcggcacaagctccgccgcctatccgggaattgataaatggctgtttgccggtgcttgtatcgcggtttcctgggtatggttcgccggactggcgttcgcgggacggctcgttcaaacggcggatacaggaggccggctcctcggcatcctgaataaatgctcggcattggtgatgtggggtgctgctttttattttgcggcgcttttgtttcgataaaaggaattcggccaggccatgttgaatgtaccggaagaagagggggaattggaatgtcagacattttaaagctgtatcactaccacagatgggcaaatgagcaagttattcagcatctgaagacgctgcccgcggtcagcttacagcagaaactgaaaagtgtttttccgactgtgaacgccgtgcttgtgcatatataccgggctgattacatttggcttcacgtgctttacggagaaactttcgaacaaatcgtctcgcagtttgatcaatttgaaaagcttgacggagattttgaggcggttgaacatagaatgactgaactggacaaagaattcagcgaatttttaaaagaaatggagaacccggaaggcccgatctctatttctcatccgcgcctggggacgcttcagacgacatatgccgatgtgatccggcatgttgtgaatcacggcacataccatcgcggcaatatcaccgcgatgcttcaccaaatgggctataaaggcgtgccgactgactacatttttttctcatacgaatcataaaaaagcaaaggcctcccgggcctttgctttttcacttcgaatctatcataatccggcatagccggagacgcccgctttttcggccacatcgtaaattgtcattttcatgcttactgatccctcttttgttctctggtattaggtcagtccgttttccggcttacgaatttgcggtattcaagcggcgaaatgccttcaatctgtttaaacagtttggaaaaataggtcgggtcctccataccgatggcgtccgcgattgcccccattttgtcattggttgcggacaaaagacgtttcgcctccgtcattctgactttgttcgtatactggccgggcgtgacgccgagcacctgctgcatacagcgggtcacgtagtcttggttgtaatgaagagccgaagagagcgctttgatggttgttttctcctgatagtgctcctgcaggtaccgggcggcctcccatgcgactctttcctttgcggacgggatttggaacgcttctttctgaagatggagcagcagctcttcaaacagaatctgctttctgagcggcagatcggagttctcggcgctgtcatcggtcagcacactgaattgcccggccataaactgcgggcgtctcaccttccctttttgcggcagggacaggcggtagcgggacggttcttcaaagctccctttttttcgcctcagctccgaccaattgttcccggttgtttccgtcacctcataagccgctccctcaaaatgaagccacgaataggatgtcgtttcttcactgccttttgtcccgtaatgttcaaggccgggagaaagcagaatatattctcccgcttcaacggaaaaggcgttttcgtcttctgtaatgtagaggacgccttctttcacatacagcagatcaaacaccgggaagacccgtctcacatgggtttcgccttttttgaatactccttctcccgcagcgataaagaccgggaacggaggaactgtgaactcgagaaaggacatattttcggccctcctttttaagtcggatttttgcaagaagtttcgtttctctccctttttattataagaaaatggaggtacacttttaaacgttgattttttcaggaaaggggttaaaagaaatgaaacaagcgattttaaaacgggctgcgttcaaacaatcctctgatcacaaactctcattatacgcgctgacttggccgatatttattgaggtttcattatatatgtttatgggaaacgccgacactcttatgcttagccaatactctgacaacagtgtggcggccgtgggtgtcagcaatcagattttaaatttaattatcgtgatgttcagctttatcgcaacgggtacgacaattgtgatttcacagtttttaggatctaaacagaaaaaagaggcgcaggaagtggcttatgtatcaataggagcgaactttgtcatcagtctcgccatcagcgccgccatattttttgcggccgttccgctgcttcatgtgatgggtctttccaatgaattgatgccggatgccaaagtctttttgcaggtggtcggcgggctgtccttcattcaggctttgattatgacgttcagcgccattttaaaaagctacggtcatacgaaggatacgatgttcgttacgatcgggatgaatattttaaatattgccggaaactttcttgtcattttcgggccgctcggccttccggtgttaggcgtcgccggtgttgcgatgtcaacgtccttcgcgcggatcatcgggctgattgcgatgattgtgatcgtcaaaaaacgcatcggactcggtctgacatggcaaaagatttttcacgtccataaagagcacttgcgaaaactcctgaaaatcgggattccgtctgccggcgaacagctgtcttacaacatttcgcaaatggttgtcacttattttatcgccattatgggcgctcaggcacttacaacaaaggtttatacacaaaacatcaccatgtttatcctgctgttcggaacggcgatcagccagggcacacagattttgatcggcagatatatcggcgccaaacggtttgatgacgcttatgaccgctgcatgaaaagtctgtactgggcgcttggcattgccgctttgacatccgtgatcatgaccttgttttcaaagcagctgatcggaattttcacaagcagccctgacataattgcgacggcgagcatgctgatcgccatgacgatcattcttgagcccggccgttcatttaatgtcattatcatcaactcgctgcgggctgccggagatgcaaaatttcccgtctacatggcgatgatttccatgtggggtatcggtctgccgctcgcttatctgttcggcatccatttcggattagggcttatgggcatctggatttcatttatcgcggatgaatgggtcagaggcattcttatgtacagaagatggcggtcgcggatttggattcaaaaagggattgcataaacgcccgaagcttcgttatgaagccgggcgtttttttatgcttgtgaaagccgttgtctcatgtcaccgagctctgatcggtaatgtgccagcaaaccggtaacggcgggccttgagtataacggaaacagctccagctcttcagacgcctcctcgaaatacgcctcggcctcgaatgcgatgtactcccatacattcataaaagctttgttgacggtatggctctccagctcttcttccgtatagccgaattgcttcatcacctggcgcgggagacgctttttcgcccgctcgtccgtatggacctccagaagcacccgggtcagctgaatggctgctcctaatgaaacggctgcatggcggagtttctcttggttccggcgcgcacaaaccggcagcagcagcaggccgagggctccgcctgtttggcccgcatacatcagcaggtcatcaaactcttgatacgttactttttctctgtcagagatttggccggcgataaactcacgtaacggctcttcttcaagcgcaaattgctgccgcacatcggtgagcgcctcccacaaaaagccgtcggcgcgtgacccgttcagaaagtcttgtgccgcctgttcaaatcctccaagttcctgcacatcaagccggtcagcttcgtgaaacaaagcaagcaccgcccatgcggcccgcctgttttttggcggcagggatgagaaagtccatttatataaaggaaagtgcgcctcggcaagctgggcgcatgtttcgtattcggtcatggtatcactcctctgttttttagtgtaccatatgtttcacaataaaaagaccgatatccttcagcggaaaccggtcgcggcactgttattcttctatatcgatacggtacgcctcaaaccatgtatggatctgggcaagatgggcgatcagctgcgggcctttcatcagctggccgaaccacggaacctgaaaagatgaaccttctgtctccagcagcatttccagcttctttctgtcaagcagggtgtgaagcacggaatctttctgttgtaaaatcgttttcagccattctgtgaccccctgcgtgtatttcgggtgatgcgttttcggataaggactttttttgcggtacaaaatatcttcaggaagcagtccttcaagcgctttccgcaagatacctttttcccggctgccatgcattttcatttcccaaggaatattccaaacgtattccacaagtctgtggtcggcgaacggcacccgtacttcaagacttgcgcccatgctcatgcgatctttgcggtcgagcagatttgtcataaaccaaagcatatttaagtagaacagctgccgtctcgctttatctgttcccgtctcaccatctaacagcggcgtttccgcaatggtttcttcatatctcgcattcacgtattctctaagattcagccgtttttgccacttttcatccaagagcgtgaccctctcctcagtcgacctcatccaaggaaatccctcttcttctgccgctgtgtgaaaccacggatatccgccgaaaatttcgtccgcacattctccggaaaggctcacgacaaaatcttttttaatttcccggcagaaccataatagcgatgaatcaacatcagccatgcccggcaggtctctgacgagaacggattcctccagatgttcaatcagctgatcctgcgtaatcacgcacttatgatgctgtgtgccgaatgcatttgtcattttatcgatccacgggccgtcatcattcggctgaaaggcgctcgctttaaaaaatttgctgttctcctcataatcaattgaataagtatgaaggggatctctgccttgtttctcaaaatgagccgcggctatcgcggttatcgcgctcgaatcaagcccccctgataaaaacgtgcaaaccggcacgtcagatacgagctggcgtgtcactgcatcctgaaataagtaccgaatgtgagctgcggtttcatcgaagctgtctgtatgcttttcgctctttacattccaataacgccatatggacaaaccgtcctttgagaaagtgaacgcatgggcgggacgcacctcgtgaattcctttaaacaccccgcagcccggagttctggacggcccgagtccgaatacttccgcaagtccgccgctgtctgtgcgggctttcacatcaggatgagcaaggatggctttcaattccgacccaaacagaaaggaagagccgtgttctttataaaaaaacggtttgacgccgagccggtctcttgccccgaacagccgcttgcgcttttcatcccagatggcaaaagcgaaaataccgttcaagcggtccacgcactcctcccgccactcaatatagctgtgcagcagcacttctgtatcagaggtcctctcaaaacggtggcccctcgcctgaagctccttccgcaattcctccgtgttatacagctcgccattataaatgatggtgtacgtttcctcttgatgcgtgcaggccatcggctggcggccgccttcaatgtcaacgaccgaaagtcttttatgtccgaataaaacatggggctctccccagacgtttgaatcatcaggccctcgttttgaaagagtgtctatcatattgttcataatatgtttctcttggacgagctgcttttgaaaatcgacccaacccgcaattccacacatgtgatatcagctccaatcccgtttctgtcggtatcaaattcgtttctatcagcactttacccagtttatgcaaagaaacgcagatagttgatttgtcccactaagagttgtatgagacaagcccgatttggaaagaacggaagagaagaaacaaacaaaggagaccggcacggttatgaaacgaaaacagcttttctcagaaaaaaacaaatgggggcgcggcaccctgatgatagaggacggcatctgcctcatcgaaaacgatgaaggcgatatcctgcttgcagacagtctaggaaacgcagacgtattgatgaaacgcgacggcagatggcagccggcacggatttgcggcggcgcggccgaaatcggtgcagacaccatccccctgctcggcggggaagaaatccgttatgaaaaggcggtcaaacggccgctgttaaccttgctcgattcgctggacgatgaaacgttcctgctgtttctcagccatctgcacgggttcggcctgtctgtatatgattgcgtattttcctacaatcaggcgctgttttccggtgaaggcgtttcgttttatcacttctcggcggatgacgcacaatgcgccctgcagcatcaccgcggcagctcgggtaaacacgacagatttgaatggacggcatctgacgggcggcgctccattatgtattcagcggcaagacaagacggcaccgcgtaacaaacaggcggcaccttttaaataggtgcctcctgatgtatttagctttgtttttcacgctgattgacgcccggcgtttgctttgacccttcacagccgtagcttttgcggtagcaagagtgattgacgcttttggcatcctgcaaatctccttcgcctcatcaacatccccctgtcacggcatttctcattcagcggcacagttgcgcagaatgtatgcgcaactaaaaaaacccggatgcatccgggtttttcaagcgattgattaaaatacgtgaaagccgatcggcaagtgaaggccgagcagcactgtcaggacgagcacgataataaaaccgatccacagtccgccggttgatttgccttttttcttgcggatgacgagcatttccatcagtccgatggtaatgatgccgagcagcatttttccggcgtactctccgttccaattcgcaaaacggacaaaaagctcagctccggtcagaataataataatgtagaataagcgcagaatcatatgcgtaatttttgcgcccttcgcttttccggaaccgtacagcccgtagctgacaaacaccaggataagcgcaacgacccatgaagtaatatgccaatgtgtcattatgttcaattccccctatcagatcaatctgcctcacttatggtaccacaacaagccgatcggagcattatcaatcgtgcgaaagacacacaattatccgatttggttcgacagcgtgccgatcggttcaattgtaatgtcaatgcggtcccccggctttaaaaatttcggcggcttaaacccttttccgacaccggacggcgtccccgtcgctataatgtcaccggcttcaagcgtcatcccttttgacagcgtttcgattaattcagctatcggaaaaatcatgtcacccgttgatcctgattggcgcagttctccgttcacccgcgtttcaactttcaggctttgcggatcactgacggccgacttatgtacaatgaccgggcccatcgggcatgtcgtatcgaggcttttgccgataaaaaactgtttatgtttcttctgcaaatcgcgcgctgttatatcgtttacaattgtatagccgaatatatgatcaagcgcatgttctttcgagatgtgcgatccgcttttagatatgattaccgcaagctccccttcataatcaagctgctccgttacgtccaagtggctgtccactgtttctccgtgtcctgtaacggcagcgggggctttcgtaaaaaccatgggatgctccggtatatccgcctcactccccatttcaacggcatgatcacgataatttttcccgatgcagatcacgttctttgaaggtctcggaataggcgcgcaaagctttacgtcagacagcgcatacataaatgaacccgactcgtcattcggttttttcgcccattccgcaagctgtccggcatgcgcgacaaacttatctcctttttgaatgcactcgatcagcgaacccggaatcgtctcaagttcaaacaattttttttcagccttttgcagatctaagattttgtcatcatcaatgatcagaccgacaaattttcggctgttcagttcccctgtcgcaaatttcatgttaatcccccatcatttttaaatctggcattcctttatgtattcttcctccgggcgggaaattcctcttttaaacaggctgaaaataagtgtaaaagagtatcaaaaattgtcacttttttagtcatattgacgaaataaaaccttcttggccaaaatgggttatactattatcatcctatgttttccaaaataatcgagaattggagatcacacgatgaacaaaattgaagaaaaaagattaactttattcgagacagcgcaaaaattcggaatcaatgcgacggagaccatcaggtgcagccaggagctggacagccttttaaacgggtgccggggcgggctcatccaacaaacgaaagacagcgggctgaacccggccgcacagattgagcacggccgcaccgcaggaaaaaaagaggctttctcataaacgtgatatgtatataaatctgtatcatttatgtataagacccggcatgcgtaaagcgccggtgtttttacgtctaaagttttttccgctcacaaaaatgtgcatttgtcataagctattttaggcaggcagcccagataagctcctggagtgcagtcatgaaaatcttcacgaaaaggatgtgctcgtatgcccgcaattgtcggagcgtttaaaattaatgccgtcggtacgagcggagtcgttcatataggcgactgcatcaccatttctccaaaagcagaggttaagacatttgccggagcgggcagcttcaataccggagacaatctcacactgacgaattacaggaattcaacgaatgtgtacgataatgatgtaatcgatcagccgatggcaggaaacgcataaaggaggcgccgtatgaatttttacgtcaatcagtcgatccatatcaattacatgcgtgtagaatctgtcagcaattcctccatactgcaaatcggaagcgccggttcaattaaatctctttccaatctgtacaacacagggagttatgttgagccggcgccgcctgtcaccgcggggcagcagactgtaacaacaggggggggtcccggcacctcatcatttgtaccgctccagccgccaagccggtagttttaatgaaggaaacgagacgcgaggtgaatgtcatgtatgatcaatccgtttcatcctacctgcagaatttaaattctttcgtccagcagcaggcgcagcagattcaggagctcgaacggcagatgaaagaattccaaaatgaaatttcaacgctgaagcagcagccttctacaagaatcgatcggctcgagtataaatttgatcagctgaaaattgaacggctggaaggaacgctgaatatcggattgaatccgactgatccgaatgccgtgcaaaacttcgaagtcggccagacatctccgcaggtcggaatgatgcagcaggaacaggcgggccagcaaatgcagcaaatccgccaaaacgtcgatatgtacttgaatgaagaaatccccgcgcttttagaacagctcgaaactcagtatgagagcaggctggacgaaacgaacaaatatcatattattgaagatatcagaaagcagatggacagccggattcagtattatctgtcccatgtcccgaaagaagaaaatacggcgcccgcgcaatatgccgagcagattgccgaacatgtgaagcgtgatattgtcagggccgtcgagcactttattaagcacatacctggtgaaatgaaaggtgatgatccgtcatgatttttacagtgattaaccggaatattgaagtcggcgacatccggtctaccggtgtgtccagttcttccttattattaatcggcgacaccgattccgtctatctgtcttccatctttgacacgcctccggaatctcttattatcgggccttatgtgccgctggcgccggaataatgttaaagcgcatttcacgcctccggaacgccaaaatcaattcagtcgggattgcgagtgtttttcaagcaggcgatacgaatgaaatcaatatgcggatcaaagtattggccgatcagcgtagtcttgctgtatacagagatgatgaaggctcatttaacaaaaaagaataccagatttttcggcagccggccgtcatgccgttaccggaaacgggagtccaaagcgcattctgccatgaaaacccttcaattcgggtaaggaatgtgaaagttcaaggggtatcgtcagcgtccgtggttcaaatcggatcgacgtcgatcgttctgggagattcgcggctgaaacatattaggcagatcttcacgccaagctcacaatcacagcagccctgacatataatgacggtgagacttctataaagggtgtcgtttatgccagcaattaccggacctatagctatcaattccatatcgggcggagtcgtaaactttggtgattccttttacctttctccaaaaagctcttctaaatctgcgctcggttcgggagcaggcaataccggagatttcctgttattaaacaacgttgtcaatgcgacaaactatatagaccccgatgtcagcgatcaaaatgtggtcggaaacgcctaaaaagcagccgctctttcagaagagggctgcttttggttcagcgttattttcgttcatttgctttttttgtttttacaagcttttccggcggctgttttctgatccatttcacaaaccgcgcgagtttcgggtcacgacgcagctcttctattcccgtgagccttgccgcaagctcctgattcgtatagagcgcgtgaacctgtttatgacaagggatgcagagcattgcggtcggaaggaatgtcccgccttcttccttaggcgttaagtggtgctccgtcagccgcacatgatggcggccgcataattcacatgtgccctcggcagaatcggccatgattccttctcctttctacatgatctccaatgtgacccgggtgcctttcccgcccggttcggacggatgaacgattaattttttcggcagacgcgctctcagctcctgcacatggctgatcactccgacggataagttgtccgattgcagcttttcgagcgctgtgacaacggtgtctaagagcccttggtcaagagtcccaaatccttcatctaagaaaaagaattgcagcgggtattgcccccgcagctgaatctgggcggacaaggcaagcgcaagcgacagcgatgtcagaaacgtctctccgccggaaaggcttgatacgggccgtttgacgcctccgttcgcgtcatcacgcatgacgaaaccgccttctgaatcgactaatatggcataccgctgccttgtcaaagctccgagacgggcagaggcgtctcgagccacgctttccagctgttcttccgctaaaaattcgacgaatgtattgcctttacatacagactggagcttatcaagcctgtcaatctgtgtctgccagcttttcagttcggcttcaatctctttaaagcgcttatgctgtttttgcataaccgcgaaggcttttgcctgtgctcctttttcctccatggcggcgcctgactcagcctctgcctgcttcagcagagaaacggatgctgtccattcttcctccgatatccggcgctcggctaatttatcagtaacacggctgatatttgccgatagctgttttgaggtgtccaagaactcatctatttcttttttcatttcctctgcacgcccttgcggaagcagactttttttgacttggtccgggtcggcaaacccggtgtcttttgacctcacgcgccagtcgttttgcgctttctcaagggaggtctcagcatccctgagtgacatgagactcccggattcccggccttttgcgtcattcagtgattgctgcgcctgcttcagcgcgtcgaatagggactgttctttggattttaacagctgtaattcctgccgcaccgcttcaagctttgcggaaattgatgtttcttcggctgctgttccgagctcttgttcatatccgtcaatcacctgctgcaggcgctcagacgcatagtgaagctcgagccgttcccgttcaagccgatgcttcatctcctgcaggcgttctttctcctcttcatgttccttgaggaatgcgatgcttgtttcaatgcgcttctcacattcttctgcctgcctgtccttctcatctatcgaagcctgccaggcgtcaatccggtttggcggaatatcaccgcagacttcattgtactgattcaatcggctttctgacagcgattcaagctcttctaatgaatgtctgagacggtcggcttctttttcctcgtagcggattcgttcggcaagctgctcagcttgtttcaccgtctgctgatgcgcgctgatcagtcttgtgaccttctcttttaccgacagcatatcctgtttcatttgtttccattccaagcggacggcgctgaacgcttcatcaagcgggcgtccgctgatggaggaagcggcttccagctccggaacccggacgctttgcagaaacggacattcttcggtaaaacgccccgactgttcttctaatgcaaccttggctgtcagcacttcctgagaaagagccgccgcctcagaaagcagcgcttcaacctgctgcagctgttcctgtacagccgtatcaggcgagaatgtttcatgagcggaacgcgggcggtcatgctgcgtcgagccgcatacaggacaaggctttccttcgattagtttttccgataattcttttgttaatgcagccgttctcgcttcctctgagcgcctgcggagatcggcttgcgttttgtcagcccgttcggctgcggctttcagtgaacgttccgtttcacagaccatatggtaaacggtttgaagcgtttgataagcgtgcgtaatatcttcctcttccgttttcgctttcgctgtgagcgactcgctttctccgttcagcttctccacgtttttcagctgcgttgtcagattggcccgttctttcgtgatttgttcctgtatctgctgaaagcctgccgccagctgtgcggcggtctggcattttttccgttcatcggcggtcacttgaactgctttcagctcttctttcagctcattctgcctgttttggccgcgggtcaggcggtctttcactgcggccagctgtttcgaggcggcttcgtattcttcctcttttttgctgtgttccgcatttgttttttccgcttcttttttcgcttcaaacagtttttgttcaatggctgaaagtctttgatacagctcttcttccttgacaagcttcggctcctgttcggccttatgggcccgccatgcttcataggcttcattttgccgggtaaatgaaacggtttccgcctctgatttccgtttggccagttcgtgttcccgttcggcgcgctgcttccggcggacggcttctgtgtaacggtctgcgtacggctcaagggcgagagctgtttccgcctctttaagacgctcagtcaaatccgtgatgtacgggcgtctttcctcaagctttttctcccggcgctcatattcatctctttctgtctgcaggttccaaatttcctggtgattctcaaagcgctcttttgcccggacccgtttcttctcagcttcttcaagccgttcgttcgcttcgtgaaactgctgttcagcctgcttcagcgcatcttctcctgcgtctccgaggccggattgttcggccagcatttcattttttttcgctgccgcttcctgcgcccgccgccgcaattttttgacaagcctgtccccgtactgttccagattaaacaggcgctggagcatatgtcttctttccgcgcctttaagcgacagaaactcggcaaactttccttgcggcagcacgacggctcttgtaaagtcgtcaatggtcaggccaagaagctcttccacctttttgttcacttcattcgctttatcggccagcaccgtttgttcgtctttgatttcaatcaagcggcagagggcggtttttactttcgtttcatccgttctcttaaaaacgcgctcgaccttgtaggaaacccggtggccggattgaagcgcgaatgtaaatgagacggcgagctgctcttcggcatgattcaggatgccgtgcgtattatttgcggcgcgctccacttttccgtataaagcgagtgtcatggcatcaaggatcgacgattttccgcttccggtcggcccgaaaatcccgaacaccccggctcctgacagtccggcaaaatcaatggtctgttcctccctgaagctgtggagcccttttatcgttaacagaatcggcttcatgtcgcatcctcctcatcatctgctgacgcaagctctaaaaacagcttgaccatctcctcatccggcacgccgccgcccgtttgtttttcataaaacttcttaaatcgatcctcaattgatgtgtgtttcacttcaatccggtcattgtcggtctctttttcttcaaaaaccggcctgatatggataaagccgggatgcgcctttctcagccgatgaatttcctcgagagaaagctgatccgtcaaatggatatcaagatcgatccaggcattccggtcacgcccttcatcaagccagccgtgaacctcgctcagcccctgcgctttccatttgacgagcggtttaccggaagacaggaaaatctcttcccacttcgcttctccgccgggcttcgcttctaccaccgtcaccgatttggcataaccggcttctgaaaagctgtatgccagcggagagcctgaataacgggcagccgtcttggcgcgcttgatcgtttgcggacggtggagatggccgagagccacgtaagccgcatcagccggcaggctgtcagcggcaactgtgtaagcgcccccgacttcaatcggacgctctgaatcagtctgatttccccccgcgacataaatgtggctcgccgcgattttcacggcatcgttccggcacagtccgcacatgtgagcaaacgcctctctgattttcacatcgtaatgatcgcgaagaagcttttcctcaaacgtatcagaaagcacttcgtttaatctcgcctctgacggatatgccagcgcggctacggctaacagctcgtccgtcgacggcacctcaatatgcacgggttctgtccgcggatagccgattaaatgaatgccgcgctcatttgttaacggagaagccgccgccagcctgtcgggattgtcatggtttccggcaatgacgacaaccgggcgctttccgccgtcagaaagcgcggaaagactttcgtaatacaattgttcagcgagcgcaggcgggttgaccgtatcaaatacatcccccgccataatgaccgcatcaatattttcttccttgacaatggtattcagctcttccaatacctcggcctgctcgctcagccggcttctgccttccagcgttttgccgaggtgccagtcagctgtatgtaaaatgcgcataccgcattcacctcactttttgatagaaaaaaagatccgctccaaaaaggagcttcggatcttgttacagtgtaagaacgtgacctccatcgaagaaatagagcgcacgccctttcactttcgtttttgtaatttgttcaaccgcttttgtatacaattcgatttgtgtttcataccttttttgcagaatcggagccgcgccttcaaatccgttccggaatttcccctctatccgatcagttttatagtccagcaaatagagaccgtccgcagtttcatagaggcagtcaataatcccctgcacgagcagcggttcaccggccgtttcggcatccttgtacacctcgccggccggaagcgccatactgaacggcacttcccggtcaatccgcagcgccccgagaaggtctttcccgatttcagttccgaaaaactggacaatttcttctatatcaatagcttcctgctgttcttctgtcagcagctctttttcgtaaagcatccggaccgtccgctccgcttcttcggcagtcggaacgtgcgtcagcggtatgtgctgcatcaccgtatgcatcgccgtccctttttcggcggctgtcagcccttttttcatcataaaaccgggacgcctgtataaaagcgtgtctcctgacggtttgatgagagagcggccgctgtattcatcctcgtattcttgctttctcttcagctcagaaactgactgcttcgttctgatagccgtcagctctcggtacggatattcccattcaagcagacggcgcgcctgatcatcaaatgaaaacgaatcaggaatcggctcgccctgctgaatcgctttgagacgtttgctcttttcttcagcacgttcttttggattctcttccagcaattcactttgctgcagcatccggatgtgaaaacgcgacgggtcgcgcgcgatatcctcagatgaggaaagtcccggcgtcctgtgcgcctccatgtcacggtggcggatgagcgccggcccgataaagtccaaataagatgacgcctgatagcggtcgaattcagaaagaagccaatcggcccggtctgcttgcgcctgccatttggccagctgtttttcccggtttttgcaggaaccgacgagaaacagcttttccttcgctctggtcagcgccacatacaatacgcgcaattcttcggataagagctctctgcgcatctttttcttcatcgccacaagcggaagagtcggatagctgattctgagttccggatggatatacttcgtgccgaaaccgagctctttatcaagcaggtatgatttgttgagatccatcatattaaaacttctgccgagtccggcggtgaaaacgacggggaattcaagtcctttgctgctgtggatcgtcatcagccgaacgacatcctcctgctcgctgagcgcccgggccgtccccagatcatcgccgcgctcctgcatccgttcaatgaaccgcaaaaagcggaataacccgcggaacgccgtcgcttcgtacgagcgcgcccggtcatacaagacgcgcagattggcctggcgctgctttccgccgggcatgccgcctgcatagtcaaaatatccggtatcgcggtatacttcccaaatcagctcagacaccgaatgattcgtcgaaaatgaccgccacttttgcagactgtcataaaaggttctcagtttttgatacagttcatcatgtctgtcagcgttcgctatatatgctttcagcgcttcataaaacggcgcttttttcttttcaaggcgtatcagcgcaagttcattttcgtcacatccgacgatgggcgagcgcagcacggaagcaagcggaatatcctgatacggattatcaatcaccttcaagactgaaagcgccgcagccacctccacggcttcaaagtaacccgacgtcaaattggcgtacaccggaatgccctggtttttcagctcttccattaattgcggcgcccacggcatggagcgcagcaaaattacgatatcccggtactggatattccggtgtgtttttgttttgccgtcatataccttaaacggagatgagacaagctttcggatctccccggctatcgctttcgcttcccagtgcacggtttcaaagtcttcggcatcctcggagctgtctgcgccatcagcgctgtcaatgagcagcagttccgtttttgccgcgtcattcggcggatacgatgcgccgagcttcaatgccgcctgttcatcgtagtccacttcgccgatttttccgcccatcagctgcttaaacaagaaattcgtactgtccaaaatatcggagcggctgcggaaattttggttcaggtcaattttctgccccgcgcctgccccgctttctgtaaaccttttatatttcccgagaaacagcagcggctcagcaagtctgaaacggtagatcgattgtttgacgtcgcctaccataaacagatttcccgcctcttcattcccgcttttaacaagctgcaggatagattcctgcacaagattggtatcttgatattcatcaaccagaacttcatgaaactggtcttgataataaacggccgcttcgctcggcacccgccggccttcttcatcaaccgcagttaaaatcgccaggcagtaatgttccaaatctgagaaatcaataattgatttttcttgtttcgccgcttcaaatcgttttccgtacgatatcacgagctgaacgagcgtttcgatgacaggcttcatatctgctaaactctttaagtgatcttgcggacttcttgtaaaataatcggtctttaccttttcgatcagtttcttcgcgccgtttcgcaaatcggtcgcttcgtccaaaagcgctttgtcaaattcatcaccctttaccgccttcgcccgcttaaatgagactgcgggaacccgttcatacagcgcatcgaagtcatgccggcagctgatcagctcttctatctgctgaaggtcatccagaaaattatcagcgcgcggggccggcccgccgggcgcttttgtcagttcaagcgccttctcaagcttttgttttgccccgaagagcgccatttcagcatcttctttcacatactggtaaaacggaagctcttccattttgctttcttccgtcacgtcatacaggcggacaaagctttgcagccatacttccgggtcaggatgcgaccgggaatactcgtacacccgtttgacaaggtcttgaagatccagatcatgcctgtctgtcgtatatctgtccgcaagctcaaaaaacgcctgattcccttttgcgtattcatcttcaaacagctcatcaagcacttcgtctccgagcaattcgccttccgtctggtcagccatccgaaaaccggggtcaagatcaatcatataataatattttttaagcacttgcagacagaaagagtgaagcgtcgaaatgctcgcccgatttaagagagagagctgccgtctgatatgcagagatcccggatttttggcgagctctttttctaatgcttccgcgatccgatgcttcatctccgctgctgaggcgtttgtaaaggtcaccacaaggagcctgtcaacatcaatcggatcttcttccgcggttatctttctgatcatccgttccacgagcacggccgttttacctgatccggctgcggcagcgaccagaatatcgcggccggaagaaacgatggagctccattggtcatccgtccatatgctgtctttcggtttaggaatttgcatcatcatccgcctccttcttcagccaatccagtatggtgccgtctttttccgctttcaggctgcggtattcattttccttaagcgactcatcaaactggcacaccgattgaaacgcacagtacgtacaaggcgtcttatctttcagcttatacggggtaatggacacaagcccgtccgttatcgcttcgcccgcctgttcaaatgtccgccgcacatggtctgtcagcagatgaaaatcccgttcgctgaccgcggctgagtcggatcttaaagaaccgtcctttttcaaaccggcattgacgatatttgaacgcccttcctccaaagtcgtgtccatcaggctgatcgcctcccggtcaccgaggagaaggcctttcattttaaatttcttaaaaatttcctgctcgatttcatcaagccccatcggcagactggcctgaatcatcggatcatgaatatggaaatacaaaacgcctgccggggtcgctttcataccgagccaatcttcggaatgtgtaatcgataagtcaagatatgtgagcatttgcagagcgagcccgtaatacacctcagccagatcaagccccctgtcgcttgatttataatcaacgattctcagcagcaggccttttgaactttccgctttatccacgcggtcgatccgtccgacgagttccatcgtacagccgtttttcagcgtgaaagtgagcggaggcagcggcccgcttccgccgaaaccgagttcaagaccgaccgggacgaaaccgctcgccttcgcatgctcgcttaatatgcctgaaacacgcgtgacgatcttctgcagtttttccttcacataaaagtgtctgtttgagctgagcagaatctctttttgcagctttggcgcaagccgttccaccgcttcataggagaaattccggcactgatctttcgtcagatcgcgccattccagcttctgctcacgaagccggtctgaaatcagcttcaggctggagtgaaacagctggccgatatccggcgcgtccagcttgaaaaactgccgctcttttaattgaagcccgtgagatgcaaaatgagagaactggcaggcattaaacgcctccatccgggagacgcttcctttaatatgctcgccgtaaagctggcgcgaaacaggccgttctagacgcttcgcctcattgcggaaaaacaagcttgaaaacagctttttcgcacgccggtgatcaggctctttcatcagcacattgtatgcgctccaccatacgtcactgatctcgtactctcttgtccacagcctgagctgacttgccgtatatgtctgagccacctgtttattgacgagatactgaagctgctcttcttcgcttacctgctcgggatcagccgctgacagcttttcctgatgatcgggaaacagctcgccaagcctgtttacaacgattgacggcaggagcgtttttccttccgcatcggcaatcgggtatgacacataaagacggtcagacggactcgacagcgccatatagatgagaaaatgctcatcaagcagccgctcacgccccgcggaagacagctccactccgactgctttcagccactccctgtcatcatcagacagcacgccgttttcatccgggcgcgccggaagaacgccgtcattggcaccgatgacgaatgtgcaggacgtgccgtacattcttgagagatccatattccctacaaatacttggtcaagcgcgggaggaattaaagaaaaatgaagcgattccgttcccgtttcaagcatttgctggaacagcgccaaagatatttcatcttcacccatcatgccggtaaactcctcgagaagctggataacggcatcccacgcctggccgtgctgctgcgcttcgatcatgtttccggcctcttcggcccgctgccttttccggtccagcttcaggggaacatcggtatcttccaaaaagagataaagagcctccgccatgctttgaaccgttttcgcttttttcatccggttctgaagccggacaaggggtgcagctatccactctctcgtctcattcagcatgtgttccatctctatttcctgatccgtctgcgcgaaatcctcatcgagcgatacgaagcgcctgtatacaaaccgctcgccgttcgtccagcgctcccctttaatgccgtaggcgatacagtaattttcaagctgatcaacctgctctcttattttctgctccggctgatcaagcgggaataacagttcggttttcgcacagcggaacaccgcttcatatctccagttccccttcacgacatccaggcttgaacggatgaattcaataagcgggtgatgctgcatagaagcttttccgtcaataaaataaggaagcccgtaatcggcaaacacttccttcagcaaatctttataatcttccggctgacggatgagaatcgccatatctttgtaccggtatcctccatcccggacaagtgattgaatttcccggacaataccttcaagctcagctcttctgttttgcgcctgcatgacggtaaaagcttcctgtccgccggtatacgccgcggcgggacgcacatcgtactgcgactctatacaggcaagctccggcgcatactgatgccgcttcgtgccatgcagttccttgcaggaaatatcggcattcaattcctttgccgtctgataaagcttatagtatgtgcttcccgtcattctgaacagatcgagctcatccggtgcctgttccgccgaagggctgtccgccgtcagcgagaatgtgacatgttcagcatgcatgatcagctgctccagcacccttaattcctgcggcgtaaattgatagaatccgtcgacgtaaacacgggcgccttttacaacgtccgccaaaggaatctgctgagcgagcagcgtcaaataatcctctgaatgcaaatagtgtccggcgaggcttctttccatctgctgatataaaatgcctaaatcatgaagtttttcagacagcatccgctctccgcgatattctgacgccgttccgctttccgccatgcggcggacgtcttcaggctcaatacagtaccgcttaaactctgtcagcatccgttccacctgctcagtgaatccggttttgtcactcgctttttgatacactttaaactcgtgcttatattcttcaatcagtttccttaaaagcatctgcacacccgtcgtcgtcacaaacgggcggttcatgcccccggtatgctgaagcacgcgccacgccaaacgcgaaaaactgaacacttgagcgcgtatcatgccgccgatatccggcgttttagcaagctcatattccattaaaaacgtcatttgatccgggactagaaaaatgatcggtttcccgaacggctcccggcgcagttcatcttgaatgctgtcgataatcagcctcgttttcccactccccgatctgcctactaaaaactcaacacccaaattaaaagacccctctctttttatctttctacattttatcgaaagttgacgaaaatgaccaatctcatctgctggtaaaaacgggatgactgttttaaaaaatatcgtttttgaccaaaataaagaaaaaaggactaatgatgatgtcagaatatcccgaagtaattgtacggacggctctgtcgttcagcattctgtttatcggcgcccggatactcggtaaacaaaccatttcacagatgacgctttttgatttcattgcggccatctcgctcggcgccatcacggcaaatctgtcgtttaatacaaagctgccgattcattatcatgtcattgcctacattattttcgtggcaatcatttaccttgtcgcatatctttctatgaaaaacagggcccttaggggtttctttgcaggcaaaccgaccattatcattcaaaacggtaaaatacttgagcataatatgaaaacgatgcgttataccatcgactacttgaaccagcagctgcgtgtaaatgacgtatttgacatttctcaggttcagactgccatcattgaaacaaacggcagcatgtcagtggaggtcaaaccggaatttgcgcccgttacaagaaaggatctcggcatctttgccggacatgaaaagaactttgccgttgagctgattatggacggccggctggtgatgaagaatctggaagaaaaccacgtatcggaaaaatggctgagagaagaattggacaagagaaacctcaaaccggaagacgtcgtatacgctgtgcgcggaagcaacggccggctttttgtcgacacatacgacgaccatattacatcgccgctagatcaagaataaaaatgacatccgcacatgtcacgggctgccgccgtataataccctataaacatccgggggtgagtccaatgcacgagaatttttttcattatacagccatctgcagtgacgattctgtgcttatcaaggatctggtaaaatccataaacggtgaatacagcgctgtgatttgctactcaatattagccgaaaaagcgccgaccgcagaaatcagaagacgaatcgaacatatcagagaggaagaagtgcgccacctgcacgctttctcttcactgtatacgtcaattaccggaaaacagttgatgccgaaacagacggagcattgtccgcacacatacagagaaggactgagggcggcgttttatgatgagcagaaaacgaatgatttttatttgcaggcatccgatagagcggtgcatccggaagcgaagcggttatttgcccgcacagcatttgacgagcagcgtcatgccgtctggtttttatacgatatggcccactctccttcccaccatacagggggaacggtatcaaacgcgccgaacacaagctacaccgaggtgaataccggcaaataacggttcaggcagatcacgctcccccgccgggagtcttcagaccgctgacaaaccccgttctttcaacatgagagaatggggtttacttttcgagccgttttatactccctctaaacaatggataccttcttcattgtataatcagcaaaaaccctttataataaaataaaccaactggtcggtttttaaggagccgaacctcatttggcggaaaggatctgtgtgaagtgacaaatacaaaaggcggtgccggaaagagcgaaaagacgaagaacaggctcgtatccgcttcgcgtgacttatttgcaaaaaaaggatattcagaaacatcgattcgggagattttagaggcggccgaaatcagtaaaggcaatctatatcaccattttaaaggaaaagagtttctgtttcttcatatcatggaagaggatcaccgtgtgatgatcgagacgtggagggaaatggaagctgatctgaaagatgctgccgaaaaattgacgggctttgcggagctgctcagccggatgagcatcaattacccgcttatgagagcaagtgaagagttttatgcgagtgcgtttacgtcagaggaggtcgtaaagcggctcaacaaaattgatattgaatatgacgatgtgatgagagagatcttagaagagggaaatcaagacggcagctggtccattcatcatgtcgaatcaaaagtaaaaatcctgctatccgtcttctacggtttagatgtgttatataaaaacgataccattcagcaaagaatcgaattgcaaaaagaagccatctccgtgtttattcacgggtcgatcagcgctgataaacagaatgacagctgacaaaggagaaacaacatgcaaaaaccgatcagagaacaaaaggctgtactcatcatcttattaagcaacatatttattgcgtttttaggcatcggattgatcattcccgttatgccgctgtttatgaatgtgatgcacttgacgggcagcacaatgggataccttgtcgctgccttcgccgttgcgcaattaattgcatcccccattgcggggagatgggttgaccgcttcggcagaaaaatcatgattctcgccggactgtttttgttcgcattatccgaactgaccttcggattgggcacacatgtctccattttatatttcgcaagggtgctggggggcatcagtgccgcttttatcatgcccgctgttacagcgtatgtcgcagatattacgacggtgcaggaaagatcgaaggcgatgggctatgtatctgccgccatcagcacagggtttatcatcgggcccggcataggaggatttattgccgatcacggcgttcgtatgccgtttttctttgcggcgggaattgcatttatcgcagtgatttcctctgtctttatgctgaaagagccgttaactaaagaagaacgcgcaaagcagctggaaagcgtcaaagaatcaaccttcttaaaagatttgaaaaagtcgattcatccaaactacttgatcgcctttatcatcgtttttgttttggcattcggactgtcggcgtacgaaacggtattcagcttatttacaaaccataaattcggcttcacgccaaaggatatcgccattattattacgttcagctccattgtggcggtcctcattcaagtactcgcgttcggaagacttgtcaacttcctcggggagaaaaaagtcattcagctttgtctgatcatcggcgctgtgctggctttcgtttctacggtgatgtcaggatttttgcccgtgctcgctgtcacctgcatcattttccttgcgtttgatttactgcgcccggcactgactacttatttatcgaaaatcgcaggaaatcagcaggggtttgttgccggtatgaactcaacatacacgagtttgggcaccattttcggcccggctctgggcggtattttatttgatatgaatattcacttcccgtttctgttcgcaggtgtggttttatttctcggtctgggattgacctttgtgtggaaaggaaaagcgggcgaggtttcggagtagggtgcactcacccatctccggagctttttttgcgtttgcgataagaaaaatgaatggattatgagaaataattcattatttatttatctcaaaatctatactatagtaatagtaaggttaacgagcttaacaatttaatatgaatgtttcaggaagaagggttttcattgaagaaagacaaacatctccttacggatatctggtttattctcatcagtgcggcaggggggtttcttctttcgcttacagggatgtcgatcgcctggatgctcggaacgctggccgccggctgcatcctctccatgacgaggccccgctggctgttcatggcgcctgacagaagagggattcaccgcagatggcttgcagcgggtcaaatgatcctcggcatcgaactcggccagaaactgaacctgtccgttctgtcggttttacgggagcattggcttccggtaggcttcatgctgattttctctatcgtgatggcgcttgtttccggatatgtgctctttcggttcagccggacggacatgatgacaagctttgtaggcacggcgccgggcggtttatccgccatgcccggtatcgcccaggaagtcggcgcaaacaccgcgattgtaagccttattcagctgacgcgcgtccttttggtcgtcatgacaataccgtttctcgtcattttcttatttaccaaacaaaacggtgcggctcagtcatcagccggagccgtttcggcaggcgcttcacatccgggccttattcccgtcttgttaacggccggatttattttggctgcctggcttgcaagcaaaggcgcaaaacggctgaaatttcccgccccttggctgctcggcagcatgatcggcgttgctgctgcggaaatcggcgtgtccgccttggcgggcaaagacatgctggcctggtggccgccggaagcgaaccagctgtcacaaatttttctcggcgccacaatcggatcaaaaatgtacaaaagcatgttcaccggcgtgacgagagtgctgaccgtcggatttatttcttccgtcggattaatcgccgccatgattctgagcgcggttgcggtttctaaattaacgggcatctccatgattacatctgttctcgccttttctcccggcgggatcgccgagatggcggcgacttcgatcaccctgcacgaagactcgactttcgtcgtcgcggttcaggtcatccggatcgttctcgtcatcgccatgcttccgcccttctatcggctgctgcaccacctttctcagctgaaacgggcacacggtgaaagaggccgggcagaaagaggaacatgagccgaataaaaaaacacgcatccatatgcgtgttttttatttgaacagctctccgccgccatttacagaccgccagtttgctgaaagatcacggaacagccgttcagcaaataacagttcttcatctgtatagcggtctaaaaatgccaagagccgcttttttatcaattcatgatattcatgatgaagggaatgcagctctttcccggcaggagtcagccggaaatagacttcttttttattgtcgctcagccgggtcctgcgcagaaagccggcttccaaaaacttcgcgcagctcctcgacacggtcggctttgtcgtcttcattttttccgctattgacgtgacattgatcggttcatgatctccgatacacgacaaaatgtgaatttccgtcaaggtcagctgtaatttttttccgttttcttcacggagttcgtccatccgtccggccaacgacgccctgatgtcctcctgacacctctcctgctcgtgaaaaatatctgtcagcccttcaagaatcatgtgttttgcatggtctggctgtcttctgtccaactgctgaatcacccttccgtattgattgtttcttttactataacgttttgttacacaagaaacaatcacacaggcgcataaaagggtatcagatgaatccccatctctccaaaccggtcagaacagcttcttccgcttcacgtcccgagccgccggctgcccatgccgcgtggccgtccggccggattaaaacggtgtggacgtcatcccaatcggcacgtgtttcagcaagctccgcactgacagctgccacgctgtccgtatcaataccggcgggaatgctccctcttaatgacaaaagcacaaaggcgcccttatgaagaaaatcatacagccgggccggccgcccgtcatgaagggtcaattcgatatccggcaggcgttttccgttcagggtatgcggcggcagctccgcatccggttcataatgcagatcaagcgcggatacttttcccgccaataaacggttggactcctgaaaatccagcaaagcggtcatcgtttctcttaatgccatccccgactcggtaaaatccatgagctttatctgggtttttatattgtgcaatacttcttttcctgtgctgtgcctttcctgatgatagctgtccagaagatgaggcgccgctttccccttcatttgcgccgccagcttccagccgaggttgaaggcatcctgaagccccgtgttcagcccttggccgcctgcgggaaaatgaatgtgcgccgcatcaccggccacaaaaacccggccggagcggtactgctcagcctgacgctcggcattgccgaaccgcgacatccataccggatcactcaatccgaaatcagtgccgcatatccgccgcaggtcttctttcagctcattttcggtgaccggctcttccttccgcttttgcggagcgtgcggagaaacgatgaggacgcggaaaagtccgtccgtaagagggacaatcacaaccgatccctccaggcggcacgttgaaaaaaaggaagattcgggcggatgtgtcaaagcggcatcacagagggttcctgttaagtcggcatcagtgcccgaaaaagcgatgcccgcctgtttcctgacaatgctccccgctccgtctgtacccgcggcatataagctgtgaagagtgcggataccgctttcgtcccggaacaccgtctccactccgtcatccgtctgggtgacagccaccgcttccgccccgcggatgatgtctgcgccgagacttgatgcatactcctccaaaatccgctccgtttctgcctgaggcagcattaacgaataattctgcttcgtatccagccgagaaaaatccagccgtgtatccagcatggaaaaatggccggaagacaccttcgtccctttttccaaaaagcgttccaatatgcctctcatggcaaaaagctcaagtgtgcgcggatgcatgataagcgctttggaatatggcaccgtcttcttcaatcgttcaataacagtcgttttcactccggccagcgccagttctgatgcaagcataagcccgaccggacctcccccgataatggcagcctgtgttttcatctcatcagccctctttcatattttttgttacgcacgtaacaaaattaccaaaaaataaaacgcctcctttttgtttcgcgcgtaacaattttcattatagtcttccctctgcttttttacaatcatttccgaaaaaaaagacgccgtttacttggcgtctgattcactgatgactccgacaatgtctttatccttaatcggaccgaaatgacggctgtcgaggctgtatatgcggttgtcgccaataacaaagtattgtcccttcggtatgcttttgcgcccggtcgtttccttcagcgtataatcaccggtcacatggctcccagcggacaatgatgactttaagggttttaaaaacggttccgccacccgttttccattcacatacagctgatcctccctgtatgcgattgactcgccggggagcccgatgacacgtttgatcagcactttgcggtgcgggcctttgaacaggacaatatcgaaacggcggatcgttttgtaacgatgggaaaacttgttgaccatcagctcatttccttgtttaaaggtcggattcatgctgattccttcgactttataatcaataaaaatggcattctttaattgtatggccaacacaacgataagcacgccggctataaaccaaaatcgttttttcaagattcctgtctccctccgtctttctcatgctgactgattctcatctgtaaacgccgttcgatatgctttccgacataccacagcaccgcgatcaccattatggcgcccgccatcctgaaaggctgtgtcatgagtgcgtgaagatcatacccgataaagctgatcataaagatcatgaccattttccccatagcggctgctgatataaactgcagcgcccccacccgtgacaggccggcaacgatatgaaccgcagcggacggcgtaaaggggaagcaaagcaaaataaacagcggaccgaaaccgtgccgctcaacccagagcatcatccgccttatggtctgatgcctgcggatgaaaccgaaagctcttttctgtccgaaacggcggacggcataaaacatcagcatcgatcctgccgcagacccgagccatgacagaaaaaaaccttcccacaaaccaaatgcattcgtattcgccaccacaaatacaacgagcggcaaaaacggaagaaacgcttcaataaaaggcagtgcagccgcagccgccgggccgaaagctctatagctttggaaccattccgtcagctgttcctcagtcaaatatgataaaaattgctccaacgtttatactccttaacgagtttgtctatccttattctacacattatctccaaaaaacgaaaatgtttacgagattttccgacttgaaatatcgtgtaagcgagtataaaataagaacaaacgttctcttttttaagaaagaaggagtatttatgcctgacatccggagcagcacccgcgatctcatcgaaaaagggctgtttctgcccatggcggctgccatcctgaaccgggacctcgaagcgcttgattcgtgcccgttcaaattaaaacaaccctataaacagcttatcagctgctctttaaaattagcacaaaaggatttgagtgatgttcgaaaagagttaagaaagcgtaaaattaaaatatacgaagcggaaagagacgaagcatttacgctttatatatgcaccattaacggctatgaagaaaaacaccgttatttcaacccgagaatacgggaacaggtaaccgccttattagaatattacctgtctcttgcgaccatttaaaaagcagccgggactgcttttccttttcaactgataaatttcagactattcacactatacattcgacatgattttctttataatcgggacacgctgttttcaatgaaaaggaggaatgttatgaaactgattcatgttctcgccgccctgccctttttcggaattctcgccggcattccatttgccaaccgggtgacgccttatgttttcggaatgcctttcattctcgcgtatgtcgtcatctgggcggtgctgacttccgttctgatggccgccgtttacaaattggacaaagaaaacaaggcgggtgaggcggaatgaacgcagcatttcccgtaatggccgccgtgctcctgttttgtgtatatctcggaatccgggcccgaaaaggaaaacatatggaccttgaacaatggacggtgggcggacgcggcttcggcacgatgtttgtctttttattaatggcgggagaaatatacacgacctttacattcctcggcggaagcgggtgggcttacggaaaaggaggccccgccttttatattatcgcgtacggctgccttgcctacattttgtcatattggcttctgccagccgtgtggacttacgccaaacaacacaaactgatgtcgcaatcagatttttttatttcaaaatacaacagcccgctcctcggcattctcgtatcgctcgtcggcatcgcatccctcatcccctatctcgtcctgcagctgaaagggctcggattaattgtttcagcaacgtcatacggacagattccgccctcagccgctgtctggatcggcgctgtctccatcacgatttatgtgatgatatcaggaatccacggttcagcgtggatatcagtcgttaaagatatcatgattttaggcatcgtcctgtatttaggcatttatctgcccattcattactatggcggatttacggagatgttcaaacaaattgacgccgcaaaacccggttttctcacgctgccggaaaccggacagagcgtttcctggttcagctcaacggttttgctgaccgccctcggcttttatatgtggccccatacatttgccgcttcctattcggcggagcatcctcgggtgtttcggaaaaacgcaatcatcatgcctctttatcagctcgtcctgctgtttgtcatctttaccggatttgcggcgattctgcaggtgcccgatttaaaagggacggacacggatctcgcgttattaaagctgtctgtgaaaacctttgatccctggtttgtcggactgatcggatcggcgggcattctgacggcgcttgtacccggttcaatgatattaatggcctcaagcacgctgttcgccaaaaatgtgtacaaagccattctgcccggcacgactgacgaaaaagtctcacggctcgcaaaatacgccgtacccgtcatcgcgctgatatccgtatattttacgctgaaaggcggaaataccatcgtcaccttgcttttaatgggctacagccttgtcacccagcttttccccgccctcttattcagcctgccgaagcggcgtttcatcacaagccacggcgcttttgccggcataacggccggggtcggaacggtggccttcattacgctgaccgaatcaaccatcggaaccctctttccgtttcttccgcagatcgttaaggatatgaatacaggcatcatcgcactggttctgaacattgccgtcatgtttgcagtcagcgccgcagtcagaaaaaaacaaatcagcgcagccgaaaaggcggcttaaatggtaagatagcggtaagatacacgaaaggggaaaaacgcatgatcatgacaacgaccgaaaccgtcgccggaaaacagattacggaagtgaaaggcttggtgacaagcagtatcgtccagtccagacacatcggcaaagacttgcttgcaggcttaaaatctgtcgtcggcggcgaattgaaaagctatactgaaatgctggaagactccaaaaaagcggtgaaagagcggctgatcagagaggcggagcagctcggagcgaacgccatcgtcggcctgcggttcgaactgaccgcaggacagaacacatccgaattaatcggatacggaaccgccgtcaccgccgaatccatttaaaaaaacaagcctctttaaagaggcttgtttttttatttctcacatgcgatatagtctttatctcggtcaagtcttttatttgcattgtaaagcgcttttgatacatacggcttgtactttgttctgccgcccttgtttttcactttcgacgatttggccacgccgcccttatacaccttattcagcgccttgcagttttgatacgttttcacctttgttttcgcttctgccgtctgccccgctccgtatgaacatccgaacacaagaccgaaagacaaaagcacagctgccgtctttttcatttctatcctatcccctctcctgagttatgcggtattgctgaacatatcatagttcaaataatatccatttacaagataaataggaaaatagttttaatttacgtccgcccgtatatcttttatggaatttttcccaaaaccttttataatatgaattgatagcgcgatctgactatgatgataggaggagaaatgatgatgaaaaaagggctttttgcgggtgtgctcactacagccgttctattcggcacatgtacggcggaaattccgggggtgatcagccccaatacggcggaagcggcgtcccagctcagcaaaggaatcggcggaagggcctacctgaacagcacgggctcagttctcgtcacgaaaattcagcttccaagctcaattcaggtgtcaaatgggacagcctatatttactcaggatttaccggaggcacagaggctgatatcggacttcagtacagtgacacctatcatgtatggaaaccgatcatgaaagtcggttcaaagggacaaggccaggtcaagtatctggaaggagaaagccaattcacctatacgaaaggcttccggcccggcagcaccgtacagctgaccatctacaaaaatctgaacggcaatacccgcgccacatactggggcacaaataatgacggatacaccggccgcattatctcagaactcgcccaaaccaatgtaggctctgtctcaaaatggaaagcgctcgccaccgtcgcggtcacatcagaggatcagcgcccttacatcaaatcaaacttctcaacagcctttacgaacatcacgatcgacaataaagcagtcacacctgtgattgatacacaggattttgccaaattgacagtgtcaggcagcagcgtcagcatgtctgtcatcaaataaagaattttgaacgcacgatttctgtcatcgtgcgtttcgttatgtcaatactgccgccgggtgaaaaattggaaacgaggcggattttcatgtacactttatgtaaaccacaaaaatgattgacgttcagtcattattcatacaggagcgaaatttatgaacagagaaaaaaggcttgaattaaagaaagtcaaaccgaaacatttgcagcaatttaatcagctgctccgatatgttttccaagtcacgaacagtaatctgcatgaagtgggatggaaggaacccgaaatcgcctccgcaaaactccccgttttggaacaagcgcatgtattgggctggtttgacaaagacaaactcgtttcacaggcggccgtttatccatttcaagtccggatttttaataaaacgttcgaaatgggcggtgtgacgggggtcggaacatatcccgagtacgccaatatgggattaatggcgaaactgttatacaaagcattagttgacatgcgtgagcgcggtcagtccgtatcctatttgttcccctactccatcccttactacagaagaaaaggctgggaaattatcagcgataaaatgacgtttgaggtgaaagactttcagctcccgaaaatgagcaccgtttccggtgaagtggaacgcgtcgagccggaacatgaggtcattaaagaagtatacagccgattcgcgcataaaagccatgcggccatgatcagaaatgaactggcatgggatgaatattggcgctgggatttagaagagcttacggctgccgtgtattatgaccaatccagacaggcgaacggttatgttctttactggattgcagatgaagtttttcatattaaagaaatggtatatgtaaatgaagaagcgcgaagaggcctgtggaactttatttcggctcatttctccatggtgacaaaagtcgtcggcgacaattattctaatgaaccgatcgcctttctgttagaagatgctgaaattgaggaaacgatttctccttactttatggcccggattgtcgatattgagcaatttatcaatcagtatccctttaaaccgcaaaaagagaagcggacatggtcttttacactggaagatccgctgcttgaatggaatcagggcgtctttacagcggagatttcgcctgaaggaaaagccgttttaagcccgggcggcgatgctgatgcggcgaaactggatattcagacgatgacggcattattatttgcataccggaaaccagaataccttcaccgcacgggccggctcgaatgcagcccggacacattggaattcattgaggatttgctggaaacgcaaaccccttatttctcggattacttttaataaaaaaacagccctcctcagggttgtttttttaacattcctttcattatttccgccaaaatgctgagcagtccgccttatcctgaatattaaattgaatcatgcgttcaagcagctcataatgcaccggttcagtccattgaattctgaataagcgggaagtagcgctgtagccggcgcgggcaatgtcgccggcaaaatgcgtaatacccgcttcttcgggggaaacacttacatgatgcttcgctgccgcaaagccgataacaaaggtgccgtgatcggtaaacatcggcgtgttccacttgatctgcgcttctaagttcggaaattggtcagccgtccacgacaggatttcctccattcgcagacgatgatcaggactgtcgatacttgataaatagtctttgaaaacgtccatgtcttcctccatcaacatcacgtccgctagcgccaaaaacccggattttcagctttttccttgatgttaaattcgatgatcttcttaagcagatcatagtgcaccggatcagtccatcgaattcggaacaggcgcgaagaagcgctgtacccggcttgagcgatgtcatcggcaaaatgctccatcgtctctttttcaggtaaaatgctcaaatgattttttgccgcggcaaacataatgatataggtgccgtgatcggtaaatgtcggtttgttccacttgatctgcgcttctaagttcggaaattggccagccgtccacgacaaaatttcctctgctttgagacggtgatccgggttatcgattcctgatacatattttgcaaacacatccatgcccatctctcctaaaatgaaatatcattactctttacatcatcatagccaacagacggacacgatacaactctggccgggcatgtaaatcgaaaaaagccctccccaaaaggagagggcccgtcccttcacatcacagctttctctaatatctctcccccagctcccgcaaaataaagtcgtagatcattcttgtccgctcttctttcggatacagcatgaattcctgccgcttcgggatatgactgcccatcctgtcctgaaaagtggttctgagataggcggttctgtaaacctgattttcaaaagaatgataggatacttccagttccatcgttttgccgtttgagaacgtgacagctgtgtcatcaaatgccgtcggttgaaaatctttaacgtgcacatgagatatccagccgcattgaggccttgcagaagaaagtgtagggaataaaaagatgtgatttgaagggtccaccataatcggcggcttgtgagaaattttaatcgcttcatatgttcccgcttttctcccggcatagctggagccaaagtagcggcagcttctgtcgatgatgtgaatcggcttcatgctgacatacagaatgcagtctttttcaatgaccttcgaccccattttaccgtctatttcctcaggcaaaacagcgatggttgaacgatttacttcgtagctttctaagggtgcgtgtgttttctggcacataatgtgcagcctccaatccttttcttgaaaatttatactaataatctatcatctgtcattggaaaacgacaggttttttttgaatatagctaaaaatcaccttttaaagatgtaatttagtcttaaattactatttaaatattgtttttctttttcgtttcacctcatttatacgatgatcattttcgttttttcgtcaatttgcaggatatgtcgatatatttccaagtattagttgtctaaagattataaaaattaattgatttttccggtcgttatccatatactataaaaaaggcattggggggattctttatgaaagagaaaaagtcgtacactgagctcatgaagtcccgcaacacgcaaaaagcaaacgaattcgatgtgacaatggccgatatttacattcaaatggtgcttgatgaatccttgtataaacgccggctcgccatgctgaccatgcagattaataaggcgcttgatgataaaaataaagaagcgttcctcacgctttcaaaagaatatgccgcactcaaacagagtgaataagccaatccatatggattggcttttttagattatccgtttacgatggttccgccgttcacatgaatcgtctggcccgtgacatatgaggaatcatcgcttgctaagtacaaatagcttggcgccacttcaacaggctcgccggggcgctgcatcggcacgtctgagccgaagacttccacttccttcgccgagaagctcgccgggatcagcggcgtccagatcggccccggcgccactgcgtttaccctgatgccctgagtgacaagagattgggaaagagatcttgtaaacgtgacgatcgccccttttgtcgctgaatagtcaatcaatgttttgtggcctttataggcggtaatagaggccgtattaatgattgaacttccttttttcaggtgagggagcgcggctttcgttaagtaaaacattgaaaaaatattcgtctgaaacgttctgatgagctggtggctcgtgattttctcaatccccggctgcacgtgctgctcacctgcgttgttgaccaggatgtcaatggaaggaaaggcttggcccgcctggcggatgacatcgttgcaaaaggcttcgtcgccgacatcccctgcgatcagcagacacttcgccccctctttttctacatattgcttcgtctcttcggcatcctgatgctcgtcaaagtaaacgatgaccacattagcgccttccttcgcgaataaaacggatacggcgcggccgatcccgctgtctccgcccgtgatgatcgccgttttcccttcaagttttttcgccgctttcggtttgtcaaaaacggggcgcgggtccattacatattcaaagcccggctgccggttttgatgctgcggcggcaaggttttcttcttctgattagccattttgatcactcctttacattaattactatattatgagtaatttgagcatcttatacgaatttcatgtatgaacagagtcttattggaaaaattaagaatatacaacagaggaggtaaatctgaattgactactttttcaaacgacgaaccggcttcctattggaaagcaacagctgacattccttcctttcccgccctcactgaagatacggaatgcgatattgcgattatcggcggaggaattacgggtctgacaacggcatacgaactgacgaaaagaggtttccgtgtcgctgtcattgaagcagaccggattttaaatgggacgaccgcgggaacgaccgcaaaaatcaccgcccagcatgatttcatctatgccgatcttattcagcagatcggcctgaccagcgcaaggctgtatttcgaagcccatctccgcgccatggaagacatgaagcagatcatcagagacctttcgattgactgcagactgattgaacaagacgcatatctttacacgaatacagaatcaggcgtcaaaaaaatgcgcagtgagcaggaagcttataccaagctcggtattgaacacgagcttgtgaaagaacttcccgtccccgttgattgcaggctcggtctcgccatgaagaatcaggcgcaattccatccgcttttatatggtgcggcgctcgtcaaagagatcgttaaaaacggggcgcggatttttgaacagacggctgcgatcgacataaaaaaagaaccgcagccggaagtggtcacgaaaaacagacacggcatcaagtgcagctatattgtctgctcttcccactttcctttttatgacggaggcgggctttacgccgccagaatgtatgccagcagatcctacgtactcgcggtaaaaccgaaacaagcgtatccggacgggatgtatctcagcatagacaagccgtccagatcactgcgatacaccgatttgaacggtgaaaaactggttcttgtcggcggcgaaagccacaaaacaggccagggaaaagaaatgtccgagcattacgaagcgctgaaacaatttgcggaagacacaatcggggttgaaagcatcccatatcattggtctgcacaagaccttgtcaccattgacaaaattccgttcatcggtcccatctcaggagatgaagaacatattttggcggcgaccggttttaaaaaatggggcatgacaagctcagcgctcgccgcgaagcttttggctgatcatattcaaaacaaaaagaacccgttttccggcctgtttattccgtcacgcttccacgcagatccgggactgaaaaaactgatttcctataatgccgacgtggccaaacaccttatctcgggcaaacttgagaggccggacgcttcacctgagactcttcggcccggggagggaaaaatcgtaacggtaaacggcaaacgggccggcgcctataaagatgaaaaaggctgtctgcatcttgtcgatacgacatgcacccatttgggctgtgaagtcgaatggaatgacggcgaacggacgtgggactgtccttgtcacgggtcccggttcacacctgacggcggggttgccgaaggtcccgccatcaagccgctgaaacgtctcacccaagattgactaaaccattctgtacgaatggttttatttttttgcattaaaatatttttatcagattccttcattcaagttccttccataccgataaaaagaaaaagagaatatctgggggaacttatattgttatttaaaaaagaccgcaaaaaagaaacagcttatttttcggaagccgatggaaaaaaacgcatcgcgctttcaaatcaatatgcagatgtccaaaaacagctgaaaatggtcaggcttggaaacgaagaacttcatgtgcttgaagagctgcagccgttaattaaagaacatatctcaacaatcgtcgattccttttaccgaaacctggatcacgaaaaatcattaatgacgatcattaacgaccacagcacggtcgagcgcctgaaaaaaacattacggcgtcatatccatgagatgtttgccggcacgattgatgatgaattcattgaaaaaagacagcgcatcgcttccatccatttgcggatcggccttgaaccgaaatggtatatgggagcgtttcaggatctgcttctgtcgatgatgaacatatatgaagcaaccattccggatttgcatgagcttttaaaagcgatcaaagcgacgacgaaaatattgaatcttgaacagcagctcgtccttgaagcattccagagcgaatataactgccagcgtgacgaacaagaggaaaagaaagcccgtcttcatcaaaaaatccaggaaacatccggatcactcgctgatttgttttcagaaacgagcagagccgtgcaggagctggtcgataaatccgagggcatttccgaggcgtcaaaagccggcaccgtcacttccgtacatgtcgaagaaaaatcaatcggcgggaaaaaagagcttgaaagccagcagcagcagatgaataaaatcgacgccagccttctgcagattgaagaagaaatggacaagctgaatgacatcgcccagcagatcgaaaaaatcttcggcatcgtgacggggatcgccgagcaaacgaatctcctgtcactcaacgcttcaatagaatccgcgagagccggggagcacggcaaagggttcgccgttgtcgcgacggaggtaagaaagctttcagaggatacgaaaaaaaccgtttccaccgtatcagagcttgtgaacaatactaatacacaaatcaacatcgtgtccaaacatattaaagatgtaaacggacttgtaagtgaaacgaaagaaaaaatggcgcagatcaaccgtctgtttgatgacatcgtccaaagcatgaaaacgagcaaagaccagacaggcaaaatcgacgttgatttgcaggcctttctcggcggccttcaagaagtcagccgcgccgtttcccacgttgcatcatccgttgattcacttgttatccttacagaagaataaagacaaaccgatcggcctttttcataaagggccggtctttttaatgttaacttaaaatataatagagttgacatatataaagactcgctttattgtataaacatattttgataagctggaggaatacataatgaaattgacagaaatgatgcatattgccgtgtttaccgccattatgggacttttggggctgctcccgccgcttttcttatcctttacgccggttccgattacgctccagacgatcggagtgctcttatcgggaagcatcctaaaaccgaaagcggcgtttttaagccaattgctttttttgctgattgtggcatgcggagcgcctctcctttcaggcggcagaggcgggttcggggtttttttcgggccgagcgccggatatctcatcgcatatccgctggcggcattactgctgagcctcagcatccaaggccttcgctcagctgctgtcccccatttgtttatcagacagttcttgttcggcgtgctgtttttgtatgtcatcggcattcccgttcaggcttttatgatgcacattgatatcttaactgccgtaaagctcagcctcatctatgtgcccggagatctgcttaaagcggccgcagcctcattcgcagccgtaagaatcagaaaaactcttcaagcaagccggcttttgccgacgaaaggaagctgattttagtcatcatgattacatcatcatattcagatacagccggacaagcgccggaacagatcgcaattcagacagaaacagaacagatcacctatcaaacttggaacaggctggttaaccaaaccgcaaactggcttggcagccttttaggtaagccgaaaaacattgcaatattactgccgaacggcatcccttttttacaacttttcgcaggggcggcgcatgccggctgcacggcggttccgttagatccccgctcggcagcggcggaactcgcggaccagctgaacatcagcaaaaccggcctcgtcatctgtgaccgccggctgagcggcagactggacggcgtcaaaacgcctgtcatcctgtgggatgaatgcaggcctttgatcgaggcggaaaaaacggaaggcgctttgatcaaaaacgccggcctgcccttttataccggattcacctcgggatcgaccggtaagccgaaagccttcacccgctctcaccgttcgtggctggagagcttttcttgtacgaaacgtgaattcggcatttcccctgatgacaaagtgctggtaccgggcacgcttcgctcgtcacactttttatacggcgccgtcagcactttgtttatcggcggaaccgtcatccttcaaagaaaattcaacccggccggaatgaaagaccggctcagacaagctgacgttctatataccgttccgacaatgacggacgccctgctctcactagagtcgtttccggatacaccgctcaaggtgatttcttccggtgcagactggcccgcttcgtctaaacaagcgctgtcagagcgctatccccatttgcggttgtacgatttttacggaacgtctgagctgagtttcgtggcgttcttatcgcctgaagacagcgcccgaaagcctgacgcggcgggccgcccgtttgaaaaagttacaatcgaaatccgccggcccggcggagaacgctgcatgccgggcgaaacggggaagatttttgtgaacagcccgatgaaattttccggatacatcaacggcgcaaaacctgatgattccggctggatgacggttgatgacatgggatatattgatcgtgaaggctatctttatatcgaaggacgtgaaaacgggatgatcgtatcaggcggcctgaatgtattcccggaagagatagaacgtgtgctcaaccgctgtccgggcgtcagaaaagcggccgtcatcggcattcctgatgattattggggcagcatcgccgttgcggtgatcgacggagatgcaaatgtaaaggaactgaagaaacagtgccgcgagcagctggcggcatataaaatcccgaagaaatggctgttttcagaaataccggaaacagccggcggaaagatcgcccgtgccgccgtacaaaagcaggcaaaggacatgatggaatggaagctgtaattacggatgcgaaacggacaattttcgcccgggaaaacggcctgttaaaagactgtctcccagaagatttggcagctccgctgatccgccatttgagccggaacatgcccgaagacattgatgaagtcctgatcggaaacgcgacgggccgcggcgggaatctcgcccggctgtcagccttggccgccggacttcctttgagcgtgtccggtacgaccatcgacaggcagtgcggctccggactggacgccgtgagggtcgcgtgccactttgttaaagccggtgcggggagcacatacatcgcgggaggagcggagagcagcagccgttcccctttctcatcccgggcgcgcttttctcctgaacacatcggcgatcctgatatgggcatagcagcagagtatacggcacaggcttacggcgtaacgagaaagatgcaggacgaatatgcccttctcagctatgaacggagcgtcaaagcgcacgaagacggcttgtaccgcccggaaattcttccctgtcacggattcgccgctgacgaaaacatgctgaaaaagcggaacatggagcctctcatctcccgtgccaaacccgtctttcagtccggaggctctgtcaccgccgccaacagctgcggaatttctgacggggcggcggcagtttgtgtgatggaagaacaaaaagcgcggtctctcggtttaaagccgggattgcgttttatcggaagcgcggtaagcggcgtccatccgcattatccgtcagcagctccggtgtatgccgtcaaaaaacttttgaaggaacgggacctgtcaccggatgatattgatatatacgaaatcaacgaggcgtttgccgtcaaaatatgcgttttttcacagcagcttctagtgccgtattctaaaataaatgtccggggcggcgctctggccgtcgggcatccgtacggggcttccggggcggcgcttgtcacccggcttttttatgaagcaaaaagacgcccggatgcccgctacgcagcagcagcgatcggcagcggaggcggagtcggactggcgcttctctttgaagtgttaacgtaacggcagtataatagatgatatcgataaaaaatgatcggagtggagactttatgactgccgtttgtttagtaagacatggagagactgattggaatgcccaaaagaagcttcaaggcaaatcggatattccgttaaatgcgacgggagagcgtcaggcgaaagaaacaggagagtacttaaaggggtccgaatgggatgtcatcgtctcaagcccgatgaaacgggccagaaaaacagctgacattattaacggatttttgaatcttcccattgtcgtcatggaagatttcagagaacggagctacggtgatgcggaaggaatgtctttaccggaacggtcgaagcgctacccggataaaaactacccgaacatggagacagcagaagagctgacagacagaatgcttgccggtttagtgaaagttcaggagcggtttcctgagcaaaaagttctgatcgtcgctcacggcgcagccattcatgccctcttgtccgccatttctgacggtgataccggcatccaaaacgcaaagcttgtcaatgcgtgcctaagcaatatcgaacgaattgaaaataagtggcgcgtcaaagattacaatgtaagcagccacctatcagaatcataacaaaaaggcccgaattcagttttgggcctttttggcgagcatttttttctgaagatcatgtaatatggcgtccgccccgtcaatgctccggcgctccgtccataccgccctgtccgcgcggtaaacgtgtccgttttttacggctgtcagctgtttccagaggtgatttttttcgagttctttctcaccgtccaacagcacgatgtaatcaggatcgatatgcaaaagctgcccgggcgccatcttgatagagtctgatttcccgccggaatccgtctggaccgcataggtaaaccctgcgagcgtcaaaagccgggacgtaaaaaactgatcatcctttacggaaatgctgtcatttgcagcgtcaattaataaaatcgtgccgccttctgcatccagctttcttttgatgtcattcagcttttcttcctgagccgacaattgtttctctatgatgccatctttaccgaccgccttttcaatagtaagggcagcgtcaaccgcatcctgataatccgcagcttcattttttaaagcgattgtcggagcgatctttgtcagttttcggtatatccccctgtgaaggcttgagtctgcaatgatgagatcgggctttaacgaagtgatctttttcaaatcagggtgtgacggtggtccgacagacggactgccgtcttttcgctctgtccggttatccgccgcggccgccggctttatgccgagatcatggagggtatcaataaagccttcattcaatacggcgatgcgatgcgggtgcgcagccacatgcgccgtccccagatcgtgcctgacggcggtttcatgttcctgttctgagcatgccgttatgaagagaacggataagatcatcagcatactgaaaatttgtttcatctgttccccctctttcgttttcccgcaattatatcattgacaatataagtatcaatgatattcattatcattatttttataaaatggtttcacagcttttctccgtcaagaaagccgaagactgattcatgccggccgctttatttcattccgctttcgtttccatcagacttctgcattcaacaaaaggtgacatttatcctgtttttgccgcagcttccaaaaatggaatcaaaccgttcgacccagcaaacaagagagcgattgcggctgtgtacaaatactcatgtccttccatcggttttttccattaaaatttaaatatttcgggttcctattaaacgaaagagagatgatatacctaaatagaaataaaacaaattgaaaaaaattgggtctactaaaatattattccatgctatacaattaatccacagaataatctgtctattggttgttctgcaaatgaaaaaaaggagaggataaagagtgagaggcaaaaaggtatggatcagtttgctgtttgctttagcgttaatctttacgatggcgttcggcagcacgtctcctgcccaggcggcagggaaatcaaacggggaaaagaaatacattgtcggatttaaacagacaatgagcacgatgagcgccgctaagaaaaaagatgtcatttctgaaaaaggcgggaaagtgcaaaagcaattcaaatatgtagacgcagcttcagctacattaaatgaaaaagctgtaaaagagctgaaaaaagaccctagcgtcgcttacgttgaagaagatcacgttgcaaaagcgtacgcgcagtccgtgccttacggcgtatcacaaattaaagcccctgctctgcactctcaaggcttcactggatcaaatgtgaaagtagcggttatcgacagcggtatcgattcttctcatcctgatttaaaagtagcaggcggagccagcatggttccttctgaaacaaatcctttccaagactacaactctcacggaactcacgttgccggtacagttgcggctcttaataactcagtcggtgtattaggcgttgcgccaagcgcatctctttacgctgtaaaagttctcggcgctgacggttccggccagtacagctggatcattaacggaattgagtgggcgatcgcaaacaatatggacgttattaacatgagcctcggcggaccttctggttctgcagcgttaaaagcggcagttgacaaagccgttgcttccggcgtcgtagtcgtagcggcagccggtaacgaaggcacttccggcggctcaagcacagtgggctaccctggtaaatacccttctgtcattgcggtaggcgctgttaacagcagcaaccaaagagcatctttctcaagcgtaggttctgagcttgatgtcatggcaccaggcgtctctatccaaagcacgcttcctggaaacaaatacggcgcgtacaatggtacgtcaatggcatctccgcacgttgccggagcggctgctttgattctttctaagcacccgaactggacaaacactcaagtccgcagcagtttagaaaacaccactacaaaacttggtgatgctttctactacggaaaagggctgatcaacgtacaggcggcagctcagtaaaacataaaaaaccggcgtcggccatggccccgccggtttttttattatttttcttcctccgcatgttcaatccgctccatgatcgacgggtggctccctctgaaaattttgacgagaaacggcgggttgacccggctcagtcccgtatcggccaagtcctgaaacgtctcaatcgccgcttcccggtttccggtcagctcaatgccgtagcggtcggcggcgttttcctgataccgggagacggcattcgtaatcggatcagaagcaaaactgagaacggatatgagcagcaataacagcgggagggccgccagatcttcaggcccctttatatgaagcattcggccgaagaatttggacagccgcttataaagcttgtcaatgatatagaacccggctaatgacagcaggagatacccggccagtccgatgtacacgtgcttcatcacatagtgccccatctcatgccccataatgaacaaaatttcccgatccttcagtttgttaagcgtcgtatcccacaaaacgattcgcttattcgaaccgattcccgtcacatacgcattcagcgcattcgttttctccgacatatttacttcataaacatggctggccggaatgtcggctttgtcggcaagcgacaagattttgctttccagctccttgtctttcagcggatagaaatcattgtataaaggatcaatcacgaccggctgcaggaaaaacaaaaacagggtaaacggcacagtaagacaccaagcgtaaaaccaccatttttttgtatgctttgtgatcagccagtaaaacacaagcacacacacggcaaacagcggaaaactgatccagaaatcaatgacatggtctcttatccagcttgctgttgtctgcgtcgaaatatgatacgcaagcgaaacccgatatccaatccattcaagcggaagcgaagccgccgtaacgatgagtgaaatcacaaatacgaagcttacgatttgcagcacccgaaagcgcaccgcggcttccagccaatgctttatttttttggcaagccccgtaatgagcagcagaaaaaataaaaaccaatctaacggcgctccgatgaaaaataaaaaatcctttacatttgaaaagttttcagcggctgccaggcggcccgggtccataaacgaggacggatcggctttcgttccctttacggcctccgggacggcggagtcgcctgtcataaagaaataccaatagaaaaaaaggccgtacagcacataggcaagtcccgctgccgctatccatttgcgcatggaagtctccctccttagcctgatgacttactcctattgtaagcataaatgcaaataaatagaaccaagcctccgaaacggatgttaatcttttcacaacagaaaagaatggaacaacaggaagcgggaaagactaaaagacggagtgatgaatatgaaaaaaataatcgcgtttattgtagtaatcgcccttttggttattgctttcttctatgtatacagccggaccggcgatgtgtttccatcaagcaacgcagatctgattattctgtctgagcacggaaaaaaagaaatcaaaattaaagacaggcagaatgtaaaagatatgctcgatatcttgaaccaaggaaaacaagtcaaactgaccaaaagcgtgtctcccgattacgacggaacggtcaaataccatgaagaccgttttgattcattcagcatgtggctcgaaggcggcaattatatgatgtacaagtataaaaacacgtattacaaactgacccggcatgatacgaagcttgtgcaaagcatcattaaggaagaatcgcagagctgaccggatcagcatgtaaaagcgaagcccccggcttcgcttttcgtctgtcatttcggaagcatgtcccggaccgcccgcctcagcagcttcccggtcgcgttcttcggaatctcatcaagaaaaaccacttccgccggccgtttatattttgccaaatgtgtttcacagtaatcaaaaaccgcctgctctgtcagctcaccgtcccccggcactatataagcatgcaccgcttcccccgttttggcgtcaggaacgccgatgaccacggcttctttaatgccctcatggctgtagagcacttcttctacttcgcgcggatagacgttgtatccgccgacgagaatcatatctttttttctgtcgacgatataaaaataaccgtcttcatcgcgcttcgccaaatcacccgtgtacagccagccgtctttcagcgcgtgctccgtctcctcgggcatcttgtaatagcctttcatcacattcggccctttcacgatcaattctcccacttgatggtcgggcaattcgcgtccgagcgtatcgacgactttattttcgacatgtaaaatattcgtcccgattgagccgggctttctcccccggtcaaacggattaaaacaagtaaccggagacgcttcagaaagtccgtacccctccagaatggtgacgtcaaaggtttgttcaaatgtctgcaacagagcgaccggcatggaggccccgcctgaaatgcacagtctgacggacgcaaaatcctccgccttgccgtgctcgtattgatacagatagttatacatcgtcggaacgccggcaaaaatggttgcctgacggcttttaatcagtttaaacacagaagccgggctgaattgcggctcgattaagacacacgctccgctcatcagaggcgcattcatacagacggttaaacaaaaaacgtgaaacatcggcaatgccgccacaattttgtctttctcattcattcctaagtatccggcgacatcatttgcattggagaaaagattctgatgggtgagcatggcgcctttcggttttccggtcgtccctgaggtgtataaaatgacggcagtatcatctttggacaatgtcggataagttctgctgcgctccgccgggcgaagcatttttgtaaacgttgtcatttttaagcgcaattgagggtcttctgtcgatggagcgttctctgctgtctggctgataatgatatgctccagcagcggcagcgagccgtgcaggctttcaaatacgggaattaaaaggtcgatgccggcgatcgctttgacatcgccgtttttcagcatgtatgcgatttctgaaggtgtatatgccggattaacaggtatgacgacaattcccgcttttaacgcgccgaaaaacgcaataacaaaatcaggcgtatttccgagcagcagcgcgagatgatccccttttttcagtcccctgtcctccaagccgtttgcaaatgctttgattttacctgccagctcctcatacgtcatgtactgatcttgaaacagacaagctggtttttccggtttctgcgatgccgtttcttccaatttggaaaccagattcattttcccacccctttaaaaattgtaatgaatgaatagtcattcatttatccggaataaacgttcacttttattatagaaaaatatagaaaaacactcaagggcaaaaagccccgagtgccgtaaaaccggaaactataattgtttcagcgcttcactgaccggcgtgccgcccgccgtcagatcgaatgctttttcatacgtattcggttcatcaagggatgcgataacggtcttggcgacatcgtctcttgaaatggaacctctttccaaatcggccgcggctttgatttttcccgtgctgggatcatttaataacccgcccggccggataatcgtatacgtcagaccgctcgcttcaagaattttatccgcataatgctttgcggcgtaatacggcttcagcgcttcattccaattgccgcggttatgagcctgaagggcgcttaccataatgaaccgcttgatgcctgctatctttgccgcttctatcgctttcgcggctccgtcaagatcaatcaaaagcgtcttatcgtatccggtgcttcctcctgatccggcggtaaacacaatcgcgtcacagccttcagcggctttcgcgatgtcttccgggcttccttccaaatctgcaagaacggcttctgttcccgcggcttgaagcgcttctttctgctcttgtttccggaccatcgcccgcagcgtatgcgtgccgtctttttgaaacagcccggtcagccgctgtccgatctgtccgtttgctccgatgagaaatactttcatcatgatccctccccattcattatggttctatcatttcacaaaaacgggcgctgattcaaatcatgcgttcggcaaatgttctaataaatcagctcgaggaaatcttccagctctattttgccgaaatactgtttcagatcgattccggccagcgcctccttgatagcggttcggtcatactgttttccggtcagcgcctgttcgacttcactcacatctttcgcaccgaagaaatcaccgaaaattttgcagtcctgaatgattccttttttcacttcaagacgcagatcaatcgatccgaccggataacgtttcgaatgctgaagattaaatgcgggcgaccttccgaaattccagtcccagttttgatagcgctcttcggaaatcttccggatcgctttccagtcttcatcggtcagtttatattccggcacttcggaaagatcatttgtattaaaaatatggtgaagcaggtgctttttgaattcatccgccgtcattttgtcatcaagaaactcgctgatgttggcgacacggcttctgatcgacttaatgccttttgattcgattttgtcttttttcactttcaaggctgacacaacatgatcaatggcggaatccagcattaatgttccgtggctgaaaatacgccctttcgtcgaaaattgagcgttgccggaaatttttctgccgtccgcgacgatgtcatttcggccgcttaattcagcttccacaccgagctggcgcagcgcctgaataacgggttcggtgaattttttaaaattgtgaaagctgtcgccgtcatccttagtgataaaactgaaattcagattcccgaggtcatggtaaaccgcgccgcctcctgacagcctgcggacgacgatgattccgttatcttctacgtatttcgtattgatttcttctattgtgttttggttcttcccaatgataatcgacggctgattgacataaaacagcaggtatgtctgttcagggtcgagatgcttcacgcaatattcctcaatcgcgaggttgatcctcgggtcggttatgttttggttgtcgataaataacatggtgctcctcctttatttctcccacttcaatccggaagcggcgattgtcacttcgcccccgaactcggattccgcttcttctttcagcttccggtgctcgccgaaatgaggcagatgcgtgagaatcagctcccccgctccggcctccttcgcgatccgtccggcttccaaactgttcatatggccggctgacgtgccgtcctggtctgcgtaaaaattgcactcgcagatcagcagatcggcattttccgcaaacgggataaacgcgtcctggtagcttgaatcagccgtatacacaacagaagctgaaccgtcagtaatccgcatcgcataacaagtgaccggatgcaccgttttcagaaaggtaatggtgaacggacctagagaaagcgggcggtccggctgataggccactccttttgtatgcgttttatatgtaaggcgctcaaactgttctatatcagcatcatgcccgtaaatcggcagtgcatgcgtcccttttccgagaaaggagccgacctgtttggcaaattgaagcggcccgatatcagcgatatgatcatggtgataatgggacaaaatgacggcatcaagctcttctgccggaacataggcaaacagctttgataatacggcgcttccgcaatcgacgagcagagaatagccgccggactgaaacagatagcctgaagttgcttcgtttgcggccggaaacccgccgcagcacccaataactgtaactttcatatgatcctccaatgtttatgataaaaagatcctttcctccaatatacctatttttcgtacaaattgcatgttttaaacattgtgccaaaacagccgttgattttcttaaactgttataatacaatgtagagacaaaacaatgaaagagggatgggtatgttggaaaagatgtcggattttttcagaaatttacccggtaagaaatgcgaagaatgcggaaatgagattgttgagcagtatgagtgtcacattaatctgtgcaatgactgcttgaaaattaaggatatgtgacaatagggcgccgcacaattctaagttgtgcggcgcccgttttttcggccgtcatcatactttctgaatagggcgttattcaccattattagcaattatctgtacgttttaaaagattcagtatattcaatctatatttttctatagacggattgttttcttttctattataatttgttctaatagctatctttttagatacttattgcacttttttcttcgggaggtaatctatgaaaaaattacgctttggactagcgacgcaaattttcgtcggactcatactaggggttgtagtcggtgtcatctggtacggcaatcccgccattccaacatatttacagcctatcggcgatttgtttttacgcttaatcaaaatgatagtgattccaattgtcgtctccagcttaatcatcggcgttgccggcgcgggaagcggaaaacaagtcggaaaattaggcttcagaacgattttgtattttgagatcattaccacttttgccattattctcgggctggctttggcgaatctgtttcagccgggagcaggcgttaatatacatgaagctcaaaagacagatatcagtcaatatgttgaaacagaaaaagaacaaagcggtaaatccgttgcggacacattcctgcatatcgtaccgacaaacttcttccaatcattagccgaaggagatctgcttgccatcatctgctttacggtgctgtttgcactcggcatctcggcaatcggtgaaaaaggaaagcccgtattggccttctttgaaggtgtttctcatgcgatgttccatgttgtgaacctcgtcatgaaagttgcgccgtttggtgtttttgcgttgatcggtgttaccgtttccaaatttgggctcagttccctgctttcactcggtaaactggtcggtttagtatatgtagctttggctttctttctcattgttgtattcggaatcgtcggaaagcttgccggtttaaacattttcaaattcctcgcctatatgaaggatgaaattttattggcgttcagtacgtcaagctccgaaaccgtactcccccgcatcatggagaagatggagaaaatcggctgtccgaaaggtattgtttcctttgttgtgccgatcggatatacctttaacttagacggatctgtgctgtaccaatcaatcgccgctttattcctcgctcaggtataccacattgacttgaccatttggcagcagattacccttgtgcttgtcttgatggtcacttccaaaggaatggctgccgtgcccgggacttctttcgtcgtcctgcttgcgacactaggcacaatcggcgttcctgcagaaggccttgcattcatcgccggtgttgaccggattatggacatggcccgtacggtcgtcaatctgaccggaaacgcgctggcatccgttgtgatgtcaaaatgggaaggccagtatgatcccgttaaaggcgcgaaggtcatgagcctcgccaaaacagaacaaaacacaaccatctcaggttaaaatgaaaaccctgcacggaatgatttccgcgcagggttttttatgccatcggcgataaaacgtaccggtgcaaaagcttcgccgtattaagaagcgataattcatgcgtgcgttcaaaagcgtgtgaagcgtcaattcccgggccgatcagcccatggacgatgtcatggcccgaacggatggctgctgaggcatcagaaccgtaatacggataaatatcaagctgataatcaatgccatagcgctccgcaagcccggccagatgttttctgagctgataatggtacgggccgctcgcatccttcacgcaaatggagacggtatattcatccgtagactggccgtcgccgatcgcccccatatcaacagccaagtattcgacggtctcaggaggaatgttggaattgcctccgtagccgatttcttcattattagaaatcagaaaatgcgtcgtatacggaagttcgattttctcttccgtgatgcggcggattaaattcaagagcagagccacgctcgctttgtcatcaagatgccgggacttaataaagccgctcggcgtaatctgcacgcgcgggtcaaatgagatgaaatcgccgaccctgatgccgagatcggacgtctcttccttcgtccggacaggctcatcaaggcggacttccatattctcctgattccgctctgccttgccggcgtccttgtagacgtgcactgaagtctgatgcattaagatggtgcctgtataggttttgccggaagaagtttggatctcgcaatattccccttcaatcgagtgatatcggaagccgccgatcaagtcaatcttcagccggccgtccgcctttatctcctttaccatcgcgccgagcgtatcgacatgcgccgtcagcaatctgtgtttcttgtcatcacggccgggaattgtgacaaaaagaccgcctttgcggtttctgtaagaggagacgccccattcttttaaaagactttctgtataggcgataacctcgtatgtattgcccgtcggactcggaatcgacaccaattctttaatcagttccatcgtatgtttcatatttgccacaggtcattcctcctatcaattttattcttcttaaaatatactcttttgatccataacccgtccaatcttttccttctcttttttcatagaatgaagggagcatgagcataggagggaaatgtatgatcagccgtaaaccgcacaagcggaaaaggtttcataatgattggtttgaggattggtttgaggatgattggtctggtgcagccttctggggctgtaaaaaagaaaaagatcactgtaaaaagaaaaaagaagacccttgtaaaaagaagaaagataaaaagaagaaagataaaaagaagcatcatcattcatgccgccgctgctgccgtcattggtaatcgttcacacaagcccgttttacaaatagatatctcatgctccccaaacagcggatgctgcttgggtttttttattaaaattagtaccaagtaataatatcaggtgttataatctgatataaaggagtgatttttcatgtcaaaatctaaaattacagcaatcggtacatatgctccggcacgccgattaacaaacgcggatttggagcgcatcgtcgatacatctgatgaatggatcgtccagcgcaccggtatgaaggaaagacgcattgccggcgaacatgaattcacatcggatttgtgtgtggaagcggtgaaaaaccttgcagaacgatacagcggaactcttgatgatgtcgatatgatccttgtcgccacaacgacggcggactatgcgtttccaagcaccgcggcacgcgtgcaggcttacttcggctggccgcacacgggggcgcttgatattaacgccacatgcgccggactcacttacggccttcagctcgcagacgcattaattaccgccggttcccatcaaaaagtgattgtcattgccggtgaaacattatcaaaggtaacggattatactgaccggacgacctgcgttcttttcggagacgctgcaggcgccctattggtggaacgcgatgaatcagcgccgggctttttggcagccgtgcaaggaacagcgggaggaagcgcggacgtgctgtatcgcacgggactgagcacagaattaaacggcgagccgcttaaaggcggaggaaacatggtgcaaaacgggcgcgaagtatataaatgggcggccagaaccgtgcctgaggaatgcaatgcccttttagaaaaagccggcttttcaaaagacgatctggattggttcgttcctcacagcgccaacatgcggatgatcgaatccatctgcgaaaaactgcccttcccgcttgaacggacgttgacaagcgttgaatattacggcaacacttcatcggtttctattattctcgcattggatgaagctgtgaaagcaaaaaaactgtcggaaggccagacgctggtattattcgggttcggcggaggattgacgtataccggactgttggtgagatggggattttaaaagtacgacgatcgaaatctaaaaaaaagaggccctgagcatctgctcagagcctctttttcttatgctgttatttcttcttccgttttgtgttcttttttgctttgcaccgtaaaatacacgatggtcagcgcgatcatgacaacggcgatgcccaacagaatggatgcctgctgccacatgtagccgtagtcgccatttgaaatgacggcacggaacccgttgatgctgtaagtcatcggcagtgccccgtgaatcacttgatagaatcccggcaggagttcaagcgggaaggttcctccgcttgccccgagctggagcaccagaatgatgacagcgataaagcgtcccggattccccatcgttgtcgccaataattgaatcatggacaggaacgcgatgctggtaatcatcgtaaagagatagaatctccacgtgctttccacatcaagcccgattccttttaacagaaccgtggcgacaataacggattgaatcagtccgacaagcagaataacactaaatttgctgaggaaccattcaaaaccgtttctcggacgccctgaagcttcactcagagggaatacgaccgtcagcatcaatccgccgacatacaagcccatagagagaatataaggcgtcagtccggtaccgtagttaggcacggaatgaatcgcgttatcgtccgtttttaccggatcggcaaacatgctgtacgttttgtcatctgtcttaatgtccccggtttgatcagccgcatctttcagctggctggacaattgtccggtgccgtctaaaagcttgcttaaaccggtgccgagagacgcttgaccctgctcaattttggacgagccgtcatggattttgttttgcgcgtccagcagtttcgttaagccgcctgacacttggccgctccctgacactaacgcttctgatcctgatttgagctgtccgaacttgctgttgtattcgccgatgccggccgtcagtttgttttggctttcaaaaacagtctgcgctccgctgtataatttatcagttcccgctgtcagctggttaatcgcgtcttgtaccgccgctgcgccgttatacagtttcgatgtggactgaggcagtgctttcagctgatcagccttcgcttttacatctttgagcgcgctttttatgactgacatatccggaagctgaatatctccgccggacggaagctggctgacgatattgtctaaatccggaaggtcagccttcggaagcttctcattcagaagctgaacaagtttcgctttttgctcatccgttaagaaatcactgtccttaatcacctttttgaccgcgtcatcccgggcatccaggctgtttttcagatcagaaagcttcttcttaaactgctgcaggtccttttcagtctgttcgagctgcccaaccgcgttttcaatgtctgacaggttgactgaattgatcgcatcttcaaatgccgccgctttttgcgacacttcctgcgccttgctgtttaacgcgcttaatccattcgttaaatccggaagcttttgctggagctgcttttgtgcgtcaaggcttgttttcagcccgctggccacttggcctcctcctgaagcaatctgtcctgatttatcttgaatttcggcgcttgcgctctgaagttttgcgatagagctgtcaagcgtttgaattccgcttgtcactttcgccgcgccgtctgcaagctgctgtgttttatcgccgatggtggcggtgctttcagtaagcttcgctaaattttccttcagcttggcgctgccgtctttcgcgtttttcgtgccgtcgtctattttcttggctccgctgctggctttgccgagccctttggcaatatctttaaagttatcaaaaatgacttttgcgtattgctctgtcacttctttcgacacggaggctttcagtttgtcgatcgccttttccccgattgtcgcgccgacatagtttgatccggcattcgtatgatatttcagatccaacttcttcggatttttatccattaccgtgctggcgtttttagaaaaatcttcaggaatctcgaccaataaataatatttagcatttaataagtcctttaacgattgatcaagatcgcttgaaaaatgccaatcaaaattatcatttttctttaactctttcacaaggtcgtcaccgatctgaagatgtttcccttcgtagtccgcccctttatcctggttgacaacgacaaccggcagctgatccaccgtgccgtacgggtcccagtacgccttcaaaaacactccgctgtagatcagcggaacgaataatatggcaatgatggggattaacagtttcttgttcgttacaatgtctttccactggctttttattgtattcaaccctgttgcctccttccgcaaactgactcatttgacaaaacggtcacggcacctaaaaagtgaaggatcatctattatttagataatccttgaccaacatacatttccagcaattcagcgatcgtctctttttcaagaggcggatggtttttttcccagtcaaatatcagtgcgatgtagagcttgagcatcacaaaagcggtcagttccggatcacacggtttaatgcttccgttttcaatggctgtttctatcttttctttaatgtatgacagaatggcccgctccattttcacaatgacatcctgaacggctattgtaccaatctcggtgttctcctgaaaaattttaatagtcagctggtgtgtttttctgaattccaaaatcgcgacaagcgcccggtggacattttcgtgaaatgaaagctccggtttcatcgcttcgtctgcgtgttccttcatttctcttaaaatagtggtgaaaatatcatcaaacagttcttctttgtttttgaaaaacgtgtagatggttcccttccccacatttgcaagctttgccaccagatccattgtcgttgctttgtagccgaattgtgtaaaagacttcgttgccgcttccagaatgagctttttccgatcgacggacatgtttcccacctcgttaaattgaccgtttgaacgttttagtcattttgtacataagataacttatcacagtcacaaagaagattcaaatgttttctctttttattggtgttccctttacagaacgggaacatgcaaaaaaacctccgttttacgataacggaggctggtacgtttcaaataaataagccagtgaatcgtatacggcggcttttccctggtcgatacagtcggggatgcccaccccttcgaaagacgcgcccgtcgcgtatacgcccggataggaagctttcagcgcatctctgaactctttgatgcgctccttatggccgacatggtattgcggcatgctttcgttccagcgggtcacacaggtcatttccggttcgccatttattttcattacttttttcaaatcttccattacgattttaatgatctcgttatctgaaagatctacgatggattcatctccggcctttccgacgtacgccctgagaagcgttttgccctccggcgccgcgtgcggccattttttattcgtccatgtgcaggccgtgatggagaagtcgctgtttcttgagataacgaatcccgtaccttcatgctccatcttgacggctccctcaggaaaacctaaggcgacgttggcaacggacgtagaatgcatgtctttaagacatgaaaccgccggcagatcagaaagcattttcgccgcggctttatgcggggctgttactatgcatccttccgcatagagcactttgccgttatcaagcgtcacggaatatcctttctcctcgcggccgatatgggtgactttcgttcctttcatcacctttgtcagcgtaagctgcttttccagctcctccaccaacgtttgaagccctgtcgtcagcgttaaaaactggccctgctttttggccgtcagctgctgtcccgaaggctgcggacgtgattttttcataccgagaatcaggcttctgtgcttctgctcagtctgatagaattgcggaaacgtggacatgaggctcagcttatcaatatctccggcataaatccctgataatagcggttctattaaattctcaacgacttcgtcaccgacgcgtctgcggaaaaattcacccagagactgatcttccttcggtttgctcgcaggcaggacaaagtcaagcgccgcccgcgcctttccgggaacagaaaataaaccggtggagatgaacggagcgattttggtcggaatgcccatcaccgcgcccttcggcatcggatggagcgtctcgttgacgagcacgtaagactggccggtcgcattgttgacgagcagatgctcaagccccaaatctttgacgagctgcggcgcgctttttttcctttccaaaaaagaatccggcccccgctcaatgatgtagccgtctttatgcgccgtctgaattttgccgcccgctctcgggcccgcttcaatcagagtgacctcaagcggcagctgtttttctttgatttctttttccatgtagaaggcggcggctaatcccgttatgccgccgccgatgatgaccagatgttttttatcgccactcatttttatcgccttctttaccgtttaattctacttgtccagctctttcagcacgaccgctgcaagcgcgtcgataaattcaggctgtgcgttcggcatagccggacgatagtagcttgcgccgacttcttcggtcacagctttgcattcataatcattatcgtaaagcacctctaaatgatcggcaacgaagcctgcgggcacgtatacaaatgctttataaggatgcttttggtacagatcgcgcgtgagatcctgcacatccggcccgagccacggatcaggggtattcccttcgctttgccagccgactgcgtaatcggtaattccggcgccttcggcaatcagttttgcggattcctccagctggtcaggatacggatcgccgtattcttttattttttcaggaaggctgtgcgctgagacgatcagcatcgcgtcatcccgttcttctttcggcattgattcatacgttttcttcacctggctgacccaataatcaacgaatttcggttcatcataccagctttcaacagacttgatggtcaagccgccgagcttctccgcttcttctttcgcgcgtttgttgtatgactggacgctgaatgttgaaaaatgaggggcgagcacaaggctgacagcttctgtaatgccgtctttatgcatgtccgccaccgcgtcttcaataaacggttcaatatgttttaatccgatgtacactttgaatgttacgtcatcctggatttcatttaaacgctgtgcgagcttctccgcctgctcctgcgtaatttttgcaagcggcgaaatgcctccgatcgcttcatatctgtcttttaaatcttgaagcatatgaggctccggctttcttccgcgtctgatatgcgtataataacgttctatgtcctcttctttgtaaggcgttccgtaagccatgacaagaagtcccattttctttttgctgctcattttgttaaacacctcttttgatggtctgtccaccttgattttgacaggaaaatcttcttataaccaacgatctgctcaggaagatcgttccgtttttttggccgcggagtattcatgtacaaacgccgtcagctttttcagcgttgccggattgacatcagggaatacaccgtgccctaaattgaaaataaacccgtccgttttcatgccttgatcaagtatcgctttcgcttttttctcgatgacttcccaaggcgcaagaagaagcgacggatcaagattgccctgaaccgtttttgtaatgccttgttttctggcgtcatctatgccgagtctccaatcaagaccgacgacatcaagaggaaggtcatgccaatccccggccagatggcttgcgcctacgccgaacatgatcagcggaacttgttctgctgaaagctcccggaatattctgtccatcaccggttttataaactgccggtaatcttcgcggttcagcgcgccgacccatgaatcaaaaatctgaatggcttttgcgccggcgttaatctgcgctttcgcataaacgataatcatgtccgcgagcttgtccatcagcatttgccacgcttgcggcatactgtgcataaacgcttttgttttgttgtaatttttagaaggcccgccttcaatcatataactggccagcgtaaaaggcgctcccgaaaaaccgatgagcggaacattcagctgttcgtttacgagtaatcggatcgtttccagcacgtaaggaacatcctgttcgggattcagttcgccgagcttttcaatatccgcagcagagcgcaccggctgatcgatcaccgggccgattccgttttttatttcaacatccactccgatataaggaagcggcgtcataatgtctttatataaaatggcagcgtccactccgtactgctcgaccggaagcctcgtcacatacgcgcacagctcgggctgatgcgtaatttcgactaagccgtacttttccttcagcttgcggtattccggctgagacctccccgcctgtctcatgtaccagacagggacgtgatttgttttttctccccgtgccgcttttaaaaacgtatcattaaacgcttctcgtttactcatctgaatttccacctttcctcctgcaaccatacgttcgtgttcttcgcccattacactataccttgttttttcaaaagcgtatagaattgaggcttaatgttcaaaaaatcgccgaattcatgattaagaagaaaaaagcttcggctgaacgtattccgttccctctccttcttgatccgtctgtgaattatatggaacgactttgtatgaagcccctgaaaacagattggcgtacggtatgtcaaagctgccttttcctttcaccgaatccagaagtttgtcttttccgtctttcttctcatatattcggtaaacaacccgatcatccttttgaatatcccattttaattgaaccgtaatcagtcccatcgccttaaatgtataacgggccgacagggactttaccgcctccagctcaatcgggctgcccagttccttcacattttcaggctttttgaatgtccggccgttttcccccgcttttgtgacgatatctttaaagagtctgaccgggtattggcttccgcctttcaggtaatgggttttatccgttttgtcatagcccatccagacggctcccgtcagtccgggagtgtatcccgcaaaccaggcgtcctttgtcgcgccggggacgccgggaaatgtggtcgtgccggttttccccgccaggtcaccttgatagctgccttgtgaagcggttccttctttcacgacctgctgaagcattctcgtcatattccatgccgtctgtccgctgaagacgcgcgttttgccgtttttaggcccggataacgtttctccgtcttcgtccgtgatgttctctataaaaaatggcttcgtatacattccgtttgccgcaaaggtatgataagctccggcaagctgaagcggggtgacgccttctgacagaccgccaagcgcaatcgcgagtccgttgtcagaaatgttcatgccgtttttctcaagatacgattttcccgtatctacgccgatctgcttcaatgtccagacagcgggcgcatttatgctgtaagtgatcgcatcctgcatcgtcacttcccccttgtactgtccgtcataatttttcggttcatacccgtcgtaggacgtcagtttgtcttggagaagcgaatacggtttgaacttgtcttcctgcatggcgggcccgtatacggcaatcggcttaaacgttgagcccggctgccgcttcgccgtaaccctgttgtatccttttgtcacgtagtcgcgtccgccgaccgccgcgcgcacgcctccggttttattatcaataaagacggcgcttccctctgccgcctgatccgtccccggaaaatagccgctttccttcatgagggtgtatgccgttttctgcagcttggaatcaagtgacgtccggatcgtatagccgccttgaagcagctgttcacccgacatcgaataacgggattccgcctccttgatgacaagatcgatataactgtcaaaccaaggcgtttctgatgttttcttgacattaagccccaatgtccggccctgggctctgacggcttccttggcgctgatatagccttggtcgttcatcattgcaagaatcgtatcgcggcgttctttatttttatccggatgctgaatcggcgaataaagagatggcgccttcggaatcgctgccagaacggctccttctgcaacggttaaatcttttacttctttattaaagtagtagtgggacgcggcttgaatgccgtaaacgccatggccgaaataaagctggttcaggtacatttcaagcagcttgtccttgctgtaatcacgctcaagattgatggcgataatgacttccttcgtcttgcgcaaaaatgttttatcatgagtcagaaaaatgtttttcgccagctgctgggtgatcgtgctgccgccctccaccttgccgcctgctaaaacatcccggaacaccgcccggccgacagacttcacatcaatgccgtgatgttcgtaaaaccgtttatcttcaacggcgataaaggcatctctcacatcttccggaacctgctgaatggataccggctcgcgattttccgtatagaggctcgcgatttcatcaccgttttgatcgacgatttttgaagatgcgtgcagtattaatttcttttcatcgatgacataatggccgagaaatataatgataatgtatccgattaacgcgagaaaagcggttgccgccgcaattacagccggaataaagaatctttttttctttttcagcataagtcacctcgcctttcttaacttgtagtatgggaaatattgtttcgaattatgtcagaatgagtcgccaatagaaacttataccactcttttgatatactagcaagcaggaggtggctgatatgaaggtttatattacatacgggacagccgattttttaaagacgattgcaaagaaacacccgagtgagaatatggtgctgatgcaaggggaggataatgcggttttaattcatgaaacaaatggagaaaccgtttttcaggcgccccattcctatgaaagcatcgacagcgtcggggaaatcaaaaatccgggctacgccgtcctcaacaacatcgccgttacccaggaaggccgtccgctgtttgaaaaccggtttaaaaaccgcgccggcaaagtggaaaatgaacccggttttgaagccatccgcgtattaagaccgctcgaaggcgatacgtatgtcattttgaccctgtgggaagaggaaaaagcctttcaggattggcagcagtcaaactcttatcaggaagctcataaaaaacgcggaacatctgccggcatcgacacaacgtctattttctcccgcccgtcttatgtaaccgcttattacgcaatagactgaaaaccgccggagattctccggcttttttgatgtcccgattttacgcatccttctttgcaccttccgcccgcctatgaataatctgtagcaatcctatttataaacggagtggttcaattggggatcggcgtctactcggtacatctgctttatgttgcttttatcgcggccattatcgtttttatgctcctcaggaaagatacaacctttatttcactcgccggcatttttgtgattgcgctatggacgacgcattcattctccgcttcggtcagcagcctgtttcacagcttcacgtatgccgccggagaattgctgccgacgatttttatcatttgttttatcgtggcgatgagcggcctcttgaccgaaaccggtattaatgaagcgatgatttctccgtttgcaaaggtgatgaaagggccggctgtcgcgtattgggttatcggctgtctgatgtttgccatctctctttttttctggccgtcaccaggggtggcgctgatcggcgctgtgctgcttcccgcagcgatccgggcgggcctttctccgatcgccgcggcaatggcgatgaacctgttcggccacggattcgctttatcgggggattacgtcattcaggcggccccgaaattaacggccgatgccgcgggcattcccgtgagcgatgtcatgcaggcaagtattccgctcgttttgatcatggggttaacgacgacaatcaccgctttcttcctcatcatgcgggatcgaaaaaaaacgaaggcccccctctccttggacagctccggttctttggacacaagtatgtatctgccgaaaaaactcagggtggtcctggcggttttcattccgcttgtttttctcgccgatattatctgtatgatcgtataccgcctgcaaggaaacgatgcgacggcactcgtcggaggaaccgcgatcggcattctcctgatcattcatttcattgtatataaagagcggcatttagaaaagatcaccgagtattttatcggcggttttcaattcggctttaaagtattcggccccgtcattccgatcgcggccttcttttatctcggtgacgcggggtttaaaagtattttgaacaccccgctgccgaaaggatctgcggggatcgtcaatgacctcggattggccctgtcccattcttttccgatgtccggagaattcgccggcatcgccctggccgcagtcggtgcgattaccgggctcgacgggtcagggttttccggtatatctcttgcaggctcgatggcaaagctgttttccgccgcgcttcatacggacccggccgttttaacagcgctgggccagatttcagcgatctgggtcgggggcggaacattggtcccttgggcactgatccccgctgcggctatttgtaaagttgacccgtttgagcttgccaggaaaaactttatcccggttgcggccgggctagtcgtcacaacgatcgccgccatcatcattctcccgtagcaaaaggattgaaatcttctgacattttctatacaatcatgggaaaagcagacgagggggcatcgcttttgacgttaacgacacttcaaaaaagcttaaacgctcagcttgacgggctgtatgaggaaatggttgaaatcaggcgtcaccttcacatgaatcccgagccatcctttaaggagaaaaaaacaccggcgttcatcgcctcattttatgaaaagctcggcgttcccatccggacgaatgtcgggggcaacggtgtcacagcctatattgaagggagtgaaccgggaccggtcgtggcactcagagctgattttgacgctttgccgatacaggatgaaaaagatgtgccctatgcttcacaaattcccggcgtcatgcacgcctgcgggcatgacggccatacggcggctctgctcgcggtcggaaaagtgctgtactgcaaccgggaaaaactgaaagggtcatttgtgatgatccaccagcacgccgaggaattatctcccggcggagcaaaagcaatgattgaggatgggtgcctcgagcatgtcgatgccattttcggcactcacctttgggcgactgaacccgccgggacggtcttatgccgcccgggcgcagtaatggccgccgctgacggctttacgattaaagtcatcggtaaaggcggccacggcgcgattcctcacgatacgaaggacgccgttttaatcggctcacaaatcgtcacggctcttcagcatatcgtcagccggcgggtaaatccggtgcagccggccgtcatctcagccggctcgttcaccgctgaaaatccgtttaatgcgattgccgatcaggcagtcatatcaggcaccgtccgctcgtttgacgaaagtgtgcgcagcctgctcgaagcagaaatagaagccgtcgtaaaaggaatctgttccatgcactccgcttcctatgaatatcgtttcaagcgcggttatcccgccgtcgtcaatcatcccgaggaagcggcgcacgcggcggccgccgcagcggaaacagacggcgttacgaaagtcattgaaggagagccgcagatggccggagaggatttttcctattatctgcagcatacaaaaggcgcatttttctttacgggcgccgctttagaaaacgcggaaaccatttatcctcatcatcatccgaaatttgattttaatgaaaaagcgatgctgacggccgccaaagtgcttatcggcgccgcggtgagctacccccgatagggcataaaaaacagccggtacattacgtaccggctgctgtgattcttaaatgaaaaacgtgccttgccgtctcaccgagctgtgacagcagtttataattggccgctccgcccacggcggctccgacgaccggcaaaagctgaaacaatttcaccacgtccagataatcgcggtattcctgctgaaaaactctccaatcgacatcatgctttttcgaatcccactgttcaatcattgagtatatgcgtttccgctgttcaccgcttgagaaagccagctgaaaaataaacagcaaaaacaatcgttcatccctgtctttcacatcatagccgtaaatagaggcaagatcgaacagacatttcattttaatggataacagcaaaggaaaatcagccatccctaaaaaaattccgccggcccccgtaccgataccttcggctgccgcgaccttttggtacgatgcgatggtttgtctggcgagggcatctttttcagcaagcgtcataccgtttgtatcccgcttgcctttcaccagatttgaacccgccattgttgcttcggtcatttttttaatgctttctgtgatgacggcatgaattttatcaggaatccgctcatttattttcgcctgcattcctttagaaaaacgttcaagcatagaatctttgcgtaaaaaacgcgctttccattgcagtgcttcctgtatcagctgctgatcgtcggtcatctgtgtctccttctttcattgaggtttcaaaaacccgattgattacagcttgccgtactttttcaatcttccgcccatatacgaaggcatgatcacaaaaatcagaacggctgaagcaacagccgcatacagcgccccgctgactcccgcggcataggctgacgctgcacagaacagcagcgcctgcacggttaatgccgatttcatcagcgaaaagaaactttgcagcttcgctttctgattgaccgggtaaagctcctgcagagaaagatgatgaaaatgcccgaacagcgggagaagctgtattcccgtaataaagacggtaaatacggttaaagccgccgttatccacggattggcggaaacgagcataataatcaggataaaaataatcgtgagcctgacctgaatgccaagataatcatttgaacgcagaaaggcccgcgcatacatataggagaacgttttccgctgttcgaacggaatcattctgagcaaaaagtcgagatacgcccggcgttttgcctgttttttcaggtgaggcacatcggtaaacagattggcgattctgtaaaaccgctgcttccttcttaattcatattcaatatgagcttcccattttaatgatttatgttttgcggccgatgtgaaatacacataaaggccggccatcacaatgtagacggcggcagcgtacacataaaacgactgtaagacgaagtataaaagcagcatattgcagataaagcgtatgaccgcatccatcattttcatgcttctgtcattcataaacgtcatccgccactccatggcctgattccacgcttttaccgccagcatctgaataaatacggcggcatacgacgcaagcgacgcccccggacttacagcgaaaaacaggggcatgcatacaagcgacagagcaataagcggaaacagctgtgacagatagctgtacttaaatgaatgcttaaagtatgtccccattttcggttcaagcggcagcagaaacacgaggtccgcttcctttaacagcgtccggacgtatgaaccggtcagcacaaatgaaaagagcaccgccatcacccaaaatgacggaaaatgaacgggaatgtctttgacccacttgctgtaccagcttgccgcgccggcaataaaaaagatcagcacaatgacgagatgatcattgagcatatatttcatatacattctggtttcctttatatgctcttcaagccgggactgccaaatcgtagacatattattcatggccggcgtcttccttcgtcagttcgatatacaagtcatcaagagctgcgtctttcatgccgaactgctctctcagttcttccagtgtgccgcttgcccgcacttcgccgttatgtaaaataatgaaagcgtcacagtagcgctctgccgtagccaggatatgcgttgacatcagcacgcttgatccggcttttttcgcggcgtccatccgctccagcaatgcattgatcgcaagcggatcaaggccgagaaacggctcgtcaatgatataaagcgaaggctccgcgagaaacgcgcacatgatcatgactttctgcttcatccctttagaaaagtgagcgggaaaccatttcagccttttttccattctgaattctttcagaagcggaggaagccttttttcaagcgtttctttggaaaggccgtacgccatggccgtcagctccagatgctctttgagcgtcagttcttcatacagcaccggcgtttcggggatgtacgtaaattgcgagcggtagctttccttatcctccgaaaacgtcttgccgttcagctcgatcgagcctttatgcgggtccattaatccgataatatgccggatcgtcgtgcttttgcccgcgccgtttaatccgatgagtccgacaatctggttcggctcaagggtgaatgaaacattttttaagaccgggtttctcgtataaccgccggttaagtcttttaccgatagcagagacataatttctccccttctgattcgtttttcttcatagtaccaaaaataaagtctgatttgaaacgattccctttttttctcacgtgaaaagtgtgcatagttatcgttttggcggacatcataatgtatgtagaaggaaacagctttaatcaactgaaaatgaggtgtttataaaagacgtcttagaacagttggatgaaaatcaacatgtcctgtgcttacaatttcttcacacactgctttgatgatgttcttcattcatgatgaaataatcaaatgaggtgtttgtcccaggaatgattaagcagacccataagtcttcattttaaaaacaaatgaggtgcttacaaaaggcatattcaattttctgtgataaagctcgaccttctgcatcagggtgaacgcgcagccgttcatcctgttttttgttttggccgtttttgtggtacgatgagaatatacatatatttcttttcagggaggaaacccatctatgcacaaagcggacgattgtattttctgcaaaatcattgccggtgacattccgtcttcaaaagtatacgaaaatgaacacgtcgtggcgtttcttgatatcagccaggtcacaaaaggccatacgctcgtgatcccgaaaacacatatcgaaaacgtgtacgagtttacgcctgagctttctaaagaatattttgaagcggtgccgaaaatcgcacgcgccatccgcgatgaattcgagccgatcgggctgaatattctcaataacaacggtgaaaaagcgggccaatcggtgttccattttcacatgcatatcattccgcgttacggaaaaggcgacggtttcggggctgtctggaagacccacgccgaagactatacgcctgacgatcttcaggagatcgcttcaaccgtcagaaaacggcttgcctcatcttaaagatgaggtttttttgcgtccggaaacacaaaaaacataaattatatttttttatatcaaaaaaatcaaaaaattgtgataggataattgtattatttcttacactaaagcggaaaacagggagagatcgtaaacatggaacgtacaacgaatttcaatgcaggacccgcagcccttccactggatgtgctgcaaaaagcacaaaaagaatttgtcaacttcaaggataccggcatgtccgtcatggagctgtcccaccggagcacggaatatgatgcggtgcaccaaaaagcaaaaagccttctgaaagaactgatggatattcccgacaattatgatattttatttcttcaaggcggcgcaagccttcaattctccatgctgccgatgaactttttaacgccggaaaaaacggcgcacttcatcgtaacgggcgcatggtctgaaaaagcactcgccgaggcgaaactgttcggaaacacatccgtcacggcaacaagcgcagattcaaaccacaaccacataccggaagcggacctctcaggaatcaaagacggcgcctacctgcatattacgtcaaacaacacgattttcggaacgcagtggaaagagttcccgaattcaccgatcccgctcgtagccgacatgtcaagcgacatcctgagcagaaaaattgatgtcaaaacgtttgatgtcatctatggcggagcccagaaaaacctcgggccgtccggcgtcacggtcgtcatcatgaaaaaatcatggcttgaaaacgaaaacgccaacgtccctaaaatgttgaaatactccactcacacaaaagccgattcactgtataatacgccgcctacatttgcgatttatatgctgagcctcgtccttgaatggctggctgaaaacggcggtgtcgaagcggctgaacggcgcaatcaggaaaaggccgatgtcctgtacggcacaatcgacgcaagcggcgggttttacgcggggcatgccgcaaaagacagccgttctcacatgaacgtcacgttcaccctccgcgacagcagtctcacgaaaaaattcgttgaagaagcgaaagcggctaaaatgaccggactcggaggccaccgctcagtcggaggctgcagggcgtctatctacaacgccgtcagcctggctgattgtgaaaaactggctcagtttatgagaaagttccagcaggaaaacgaataaatttcttctaacataacggttcctttgatatactgtttgcatatcaatttttccggccatcgcaataaatgacgagcatattattggatggcgaaaaagcttagcagaggagagcttagtatgaaaacaaaagaattagtcactatggccctgtttgcggcaatcggagcggtgcttcattccattatgccgccggtattattcggaatgaaacccgatatgatgcttgtgatgatgtttatgggtattctgttattcccccgtgtgcagaacgtgctgatgattgggattgtaacgggaatcatttccgcactcacgacatcttttccgggcggacagcttccgaatatcattgaaaaaccggtaacggcgtttctgtttctctcgctggcgcttttggtgaaaaagagcgtgaaaacagcggccgccgccgtcattacgatagccggcaccttcatctccggtttgctctttttggcgctggcccttctgattgtcggcctgccgggcggattcaccgcattggtgctcgcggtcgtccttccggcggctgcgctgaatacgatcgccattatcattatgcatccgattgtgcagacgatcttaaaacggtccaatatgattgaaacggtgaaataaccgcataccgaaacctcttccggccggaagaggttttttaatgtgtttcagcatgttttatacgagaagttttgtgaaaaagataaggaacaatgcgagggcggttcctgctgagcagacaatggccttttggcggacgacccgcttcggcggataagaagcggcctggccgagcagtttcaggtaataaacggcgcccgccgcaaagacaagagccatacaagataaaacaatcataaagacagacaaccttctccctccttttcccttaaaaaatatgctaaaataaagcaagctatgtatagaagtttattcttctgaacaaaaatgataaaagttatgagaaaaaaaacggggtgatttcaaatggctgacggacgttcccttttaacaggccttttcgtaggcggattgatcggaggcgcagcggtgttactctcggctccttcatccggaaaagagctgcggggcaaaatcaaagcgaattgcaattcaattgaggacacaatcaaacggttaaaaaaagacggaatggcgcttaaggaccagcttgtccaaacggcgaaagaaagcgcagaagtcattaaagacgtaggcggagagcttcagaccagcattaaaaggtggcaggaggaaatcaaaccgcaccagcaggatctccagaaggaaatcgctgatattgaagagaaaatcagacagctggagaaaaccttacaaaactaatatcctatacaaccaaaaaaagtgcggacatattgcgttccgcacttttttttgcggtttaaagcctttcccagcaacggatgaagaatttattataaaattcttaaattttcatctttattaatctttattttattggcataatagaggaaaagaaaatgtgaagcaggtgatctgtattgaatcgtgttgaaccgccttacgatctaaaagaagctttaatctatacccaaaaaatggcgcagctgtccaaagcgctgtggaaatctatcgagaaagactggcagaattggctgaagccgtacgaccttaatattaatgagcatcatatattatggattgcctatcagcttaaaggagcttctatttcagaaatcgccaaattcggcgttatgcacgtatcaactgcatttaacttttcaaaaaagcttgaagaacggggatatctgaaattttccaagcggctgaatgataaacggaacacgtacattcagttaacagaagaaggggaaaatgtattcgaaagcctgcttgaggagtttgatccgtcgagaaacgctgtgtttaaaggctcacagccgatctaccacttattcgggaagtttcctgaggttgaagaattaacctgtgtcatccgccacatttacggcgaagattttatggagatattcgagaaatcattgacaaacataaacaatgattttgatagtgaagacggaaggctgaagaaaaaaacggacgaatcggctgtccatgaaacggctgaagagctggaaccgatcaacagttaatcaaagtgcttcataatctcaataaattcttccatcagcgctgtataaagcccctgctcatacagagcaaaaatcgtttcatgaacatctaatttttcgttcagctgtcccgcaaaaagcgcaaggagcttgtcaaacgtcacaaagccttgcgctttttgcgactccagctcgtcctccaattcgcggcagatccgcccgacctcttctccttcttcttcggtcagccctttttcaatcatcatcgcataaaaagggtacttatccatatccaccgttttcaccagcaattgtatgtaatattctaaacgcccgatacgctgatccattgaatccatccgtttcacttctttctatctttaatcttattttagctgataatgaatggagaagaaaggttaaaccgtacatttccatgtttcaccgagctcttctgttcttctctttccaggtttatttttttctttaaaaaaggattgattttttctcctgaagagagtaaattattttgagattgtattccatctttgtacggaaggatgactctgatgaattgctggaaaaccattaatctgatcaaagattatggtgcggttcgtttattattgactgctgtaggttttatgatcctgttttttatatgcaacttcttggcattcgggctgctgcgtccgaatatcagtttaagtgacgggcacgtgtttgctttttgtgttctgctcgttgttactttatttgtacataaagtcatacatgtcctgccgatgatctgtaaaaaaagaaaaaaggaaatgaaaatgtacttcttgcggatgccgacatggaaaggcataccgaaaacgacgatgctgatttcaacgatcagcccgtttttattcattacgccgttattgttttatgccggactggcatttccgagacacgctcattacttttatatgatttcgagcatccatgcggggtattgcctgcctgatcttctgtttgccctgcatctggtcaaagcgcccaaatcatgtctgattgaccaggaatccgacggttttgatattttagtaaaaaaagtgccggagtcttgatgtcccgctgatttttcaggttacattctatcttttttaataaatatttggtaatgtaatatgggagcagttcagagagagggggaatctcccatcattttattctattttatcgtggctgccctgtttattctttatttcataaacaggctcacaaatacattatgccttgtcagagagattcctgaagaccggcaggataaggtattccgttttattaatgtatctattttaattttactgatctcttcattcgtcgagatctcctttactgtgtaaacaggcaaaaaaatatggctgacggaggtctgacccccgacagccatatttttttcttaataaagccaagaagcgccgatgatgatcaataagatgaacagaacaaccaataatgcaaaaccgcctgcaaatacttcacccatctccaaaagcacctcctacaaaacgttttatttttccaattacatcatatgcaatttacttctgaaacgattaggcgcccgggtaagaaaacggaccgcttttagaaaaagcgatccgtttcgcttaacaaatgtaagctgcacctacgatgataagcaatatgaacagtactacgagcagtgcgaaaccgtttgaatatcctccgcccatggttcattacctccttttcatgatcaatatatttgtatgtatcaggaaaaagtttgactagacgaatgccctttatttaaaatctttttacagaaagccacaatatgttatgatacgcatatgcaatttaatttggatgattaggagtgtttaaaggaatgaagaaaatcgcgatagcagctattacggcaacgagcgtcctggctctcagcgcttgcagcagcggcgacaacgacgtgattgccaagacggatgccggaaatgtaacaaaaggcgagctctacacgaacatgaaaaaaaccgcgggcgcaagtgtgctgacacagctcgtacaagaaaaagtattagcaaaaaaatacaaagtaacggataaagaaatcgataccaagctgaaagagtacaaaacgcagctcggcgatcagtacagctcccttaaacagcagtacggcgaagattacctgaaagatcaggtgaagtacgaactgcttgcacaaaaagcggcgaaagacaacatcaaagtgactgactccgatacgaaagaatattacgacggcttaaaaggtaaaatccgcgcgagccacatccttgtcgctgacaaaaagacagctgacgaagtggagaaaaagctgaaaaaaggcgagaagtttgaaacgcttgcgaaagaatattcaactgacagctcaaaagacaacggcggcgaccttggctggttcgataaaaagtcaatggatgaaacattcagcaaagctgcattcggcctgaaagtcggacaagtcagcgatccggtcaaaacaaaattcggttatcatatcatcaaaaagacagaagaacgcggcaaatatgatgacatgaaaaaagaactgaaagaagaagttcttaaacagaaattaaacgacaactcagctgtacaggcggcaattcaaaaagtcatgaaaaaagctgacgtaaaagtggaagacaaagacttaaaagacacgtttaacacttcaacttcttctgaatctaaataaaaaaactgtgcgggctctcggcgagccgcacagtttttttatgcgatggaatgattggagttttcttccgcatccccgttttcacttgcgggcgccgccatacggcgctcgcgttcctgttccatccgttcaatatacacccttccttctttttcaataaacgactggtcaagcttttcctcttctttagctgttgtgaaaagcttataagcgctgaaaataattccgataatgcaaaggtatacccaccaaggaaaaaatagcacgtcggtttcctccctttttcacccagagtctttattctaagctatgcttgataaagacaagttatgagagctgaacgtaaaaaagaccgatcatagagaatcggcctttttatcttattgatggaaagtcggtttgtagaaagaacggttttcaagcgcaaatacacgctctgtgtattcgcccggcttcacccgttccagcgctctgtccatcatgatcatttttgcatccagattatcaatgtagtgcagaatttccgcttctttcaccatcggcggtttcgggcttccccattccgcttttccgtgatggcttaaaatcaaatgcttcagaatcagcacttcttcagcgtcaatttgaagctcttcggctgcttttgaaagctctgtcaccatgatcgaaatgtgcccgagcagattcccttccacggtgtacgttgtggagacggggcctgaaagctcttttactttgccgagatcatgcagaatgactccggcatacagtaaatcccggtcaagagacggatacagatcggcaatcgcttttgccaggttcagcatggacactacatgatacgcgagccctgaaacgaactcatggtggtttttagccgcagccgggtaatccataaactcagccgcatattttttgaccagatgtcttgtgacccgctggatgtttggatttttcatttcaaaaatgtattgagtgacggtttccatcatttcgtttttcggaatcggcgccgtttccagaaaatcatcaatgctgacattttcattctcaccggccggccggatgtttctcagcttaagctggtttcgtccgcgatagtgatggacatctccgatcaccttcacgatcgtctgcgccgcgtacgttacttcatcagtcggcttggcatcccacagcttcgcttcgatatctcccgattggtcctgcagcattaacgtcaggaatggttttccattgcttgcgattcctttagtcgaagatttaatcagaaagtattgatcgacctgctcgccgacctcgtgcagcataataccttttgccattctattaaaagctccctccatatcttacataataccagtatagcacatacctcttttttgaaaataaactcttttatgacaggagccgcatgacttgtccgctgtgaaaagaccggctgacatgctcatggcaggtgaaataaagtatctgccgcccgccttctgaaagctgattcagcacatcaaacagccgctgcagccgctgcctgtcaaaatggacaaaactgtcatcaagtaaaaacggcagtgataccgcagattccctctctgacgcaagggcaaaacgaatcgccgcataaagctgctcgcatgccgcctgtgacagttcgcctgcagaaaacaccgttccgtctttccgcatgaccataatggaatcatcagcctcggaaaaatacaatttgtgatagcgtccgtccgtaagcggcccgtataatgcaccggcggtttctaacagacggggaagcgtcacttttttatgccgctccattttttccctgataatgtgtctgaccgtctgtaatgcggcccactctttagcggtttttttcacgcgctccttctgcatttctgtctgctgttttaaatcggatacaagccccgaggactccaactgctcttgcttcaccgttaataaagcggtttgctcacggagctgggcgcttttttcctcaagcgtttttttctctgtttccttctgaacgactgtatgttcaagttcggacactgtgcggctcatgtacggctccagctgttttccgcctatgccggacaagtgcgttttgatttcgcgcagctgccgctctgtttcccggcggctttcattcagcctggcgagttcacaaaagtgttcgcggttttttgcgcctgccgccatgaaaagctgtttgacctgctgttcgtagtaatgaacttcttcgtttaattcacgcatttgctcttgtgcatgcagcagatccatttcgagcgcctgctttcgttttgcttcctcacgggcccgttccgcctgcgccagcaaaacgtgcagtctttcttttacggacagctcccttccgtctgaaggactcagctttttgacccggtcctcaaatgctctttgcagcttttgcagcctgcccgcttcaatggtcagctcatgcttgttaaggatttcttttttgacatctttcatcacatgatatgcgtcaagaagatgggaaggacttcctgaaaaccccagttccttcataaaaagttccgcctgtttttcagacggcgccatttcggcctcccattcttcatattggcggatgactctttcatatgccgcttctttctgttcaagcacggcttgatccgcaatcagctgctgccggtgccggccgtcacgccaaagctcttcctgcagaagatcagccgcttctttagagatcgccggcttctttttcttgtgtccgggccctcctctttctgacggcagcggtttttgcatgccggacagcatatacagcagcagagcaccggtaaaaagggcggcgggcagccattcctttaacatagcgaaaatcgcaatgaacagaatgcccgcaccgagaaagagctttttttgtttggcgcgctgtttttccagatgctgaacatgtgcctgccattcgtttccttctgtatcagccgtttgcttatatgattgtaaagcggcttctttttctttcttgacagcggggtccaaaatgttttccgccgtcacggcatgttttcgttcggcttcttccagctccagccgcgcttgttcgaaaatcgcatcaagctgtgtctttctttctctagcctgtccggcgctctgcacggcttcctgcagccgccattcatattcataatcggtgttcagtgaaagaatgccgtcttcctcatgtcttccgagctgctgcaatcctgacgaaacgcgggcagatgtctgccggatctgtgattggatggctgcaagctgttcgccgcgcgattcatacatatgctgctcgccggaaagctcctgcagctgccgctctttttgcagcaagtcctcatttggagcgagcagatcagcctgccgcctgagttcagccgcttttgcccgaagcccctcaagacgggccgctttcggatggagatgcgattcgtatttttcaagctgatgcattccgtccttcgggaattgcttcaatgcttccggataagaagaaagttcgctttccaaggctgtttttttgtctgcgagcggctttgcttctatcgccgattttactgttttgatttcttcagttatgtctttcaatcgtgcttcggcatcctgcaaacggccgccggcgctttttttctcttccagaaggctgtgatagcccgcttccgcagcttccgcctgtttcagctgggcgctgagccgctttaatgtatccaactcctgatttaagcgggggttccgcccgttcggcttatacatcctgtcaagttcttttgccagccgcccgtcaagctttgccgccgcttccgacccgaataagctcgaatacaggagaaactcgccgattttgtcccggttaaaagcttgaatctcctgcagtccgaatacatcgaacgaatagatcgcttcgtacagcgcccggtctgtatcggagagaagctgtttgagccattctccgtccttgatttcgcctgaagccgtatacactctgactttttcggcagcgccttttgtccgttcgattttgacagcgccgtgatcgccatgcttcaattccacagtgccgccgtaaaccccgccgtttttcggttcgtatttttttgatttcggaaaaccgaacagcacgcttttgataaaggacatcaatgtcgttttgcccgcttcatttaacccgtagatcacttgcacgggagaatctgacagctgaaaacttcggtcggaaaattttccgtattggtaaatatgcatcgccgttattttcatcgctgaagctccttcatctggcgtcttaaaacggcttgagcctgccgcttaatatccagtatctcttcatctgtaaatgaagccatctgacgccggtatacgggatgacgctcaagggcatcaaatacaccgctcatatccgcgcattgttctatgtcctgaaggagccctttaaaaaacggatcgagcggcacggtttctgtttcatccgtccgatcctcaagcgcaagcggccagacgaaacattcctcttcggcctcttcctcctgtaaagcggaaagaagctcctccgcgatgcctgcgggcgcctccgtccaaaagcggggcgctgcgccgcgaagcaccagcctgacacatgccgggcggcccgccgcgcgcaagccggagaatgtatctgatgcggctttcagaagtgaagtcatatgttcagctccggagatatcaagatcaatttcctcccataacacatcatgcgcttctttgaattcccaagacatctcaccgtttgccgcccggacgagataatatcccttaggtccggtttcttttaaatgccgggcttgaatattcccggggtaaatggcggcgggatgctgggcggacaggacctgccgtttatgaatgtgtccgagcgcccagtaatccatgccgcttttttcaaggtcttctttcgtaaacgggcagtacgggtcatgcccttccgctcctgataacatgccgtggagcatgccgatatgataaggcgcgccggtcattttccggtaacgggccgcctgattgaccgttacgcttctttcctgatagctgcatccgtatatgcttgccgcaagctctccgtttttaaagaaagatttttcctccggtgtatccgaggtgaatgtatgtacattttcaggccattcaatcggcgtccacttaccgcccaaatgatcatggttgccgaatatgacgaacacttggatatccgcttcctgtaatctcgtaaactgttttctcaaaaacagctgggcttttaaacttctgttggcttcgtcaaacagatcccccgaaagcagcacgaaatctgcctgctcccggagtgccccgtccgtcagtcggcggacgctgtgaaatgtgctttctttaatacgcgcatataccggttcaggcagattcgaaatgccgtaaaacgggctgtccagatgcaggtcagcggcatgaataaacgtcagatcagccatctcgccctcccctttctgcaaattgaattacccttattttagcaccgtttttatacgaatgcacgttctgtaaaataaaaaaacagcccggctgttccgggctgtttcacttattttttggagatgcgcagcgcttgtttgatcgctttgaatccgctggcgtttccgtaaatcaaaacgccgcctttgtaaattttcgcgccgaccgctgcaaagatcacgatagtgaccagtgtcagggtgattccggccgcagcctgccaaaacgggatatcgagcatcccgacgcgtaaaaacataatcatcggcgtgaaaaacggaatgtaagatgtaacggtaataaaaccggcgtcaggattgccgatgccgaacatggcgatcataaaacctgccacgactaaaaaaaccatcggctgaatcgtctgctgtacgtcctctatccggctgacaacactgccgagaaacgcggcaagcgtcgcgtaaagaaaatagccgagcaaatagaaaatgacagcatagactatcgtcgagacgggaacatccgtaaaattgagaaatgcactgatcggcgacgacgcatcattttgagggttcagcttcagtgagagataaccagccgcaatcagcaccgcaaactgtgtgatccccacgagcgcgataccgaacagtttggcaaacatctgctgaatcggcggcatgcttgaaattaaaatttccatgacgcgggacgatttttccgtcgccacttccatcgcaatcatgcttgcgtacatgataactgagaagtagatgacaaacagcatgatgtatacaagccccattacctgaccgagctcttcctcggatttcgcccctttttccagcgcgtctttgctgacttccggcggagtgtagaggctgctgactttttctgccgaaatgccgagcttggcggtttcaacagcggtttttgtctgggttaaagcctgcttgagcagtttatacgctgattcatcagaaatggtcagcgccttgtatgctcctgttatcgttcctttttgatcttgtctgatgataaacagtccgtcccattcaccgtctttgacacgctttacggcatctttttcggactccttcgtctccattgcctgcagatcattgtctgtatccgccgctttaagctgttttgcaaacgccgggtacagcccgcccgtttcatcaatcaccgcgatttgctgcttgccgtcatccgattgaaacacggatataatcgattgcaggttggtcaccgctaatactaataaaacggtaatggcggtcgaaataatgaatgactttgtcgcgattttgtttttatatgtatgaaacagcataatccaaaatttattcatatacggcccccaccttttctataaaaatatcatgcagtgacggctcttccaattcgaacttccgtataaaacctttcccttgcagcgcccggaaaatatcctgagaaaccggttcattcgcgacctgcagtctgattccgtcatttgtttccttccatttcacgacgccttcatgcgtttttaaaaagctgaggtcatcatctgaatgaacggtgacattttttttgccgaaagaccgcttaatgtctttcagattgccttgaacgacgggttttcccttctggagaatgcacaaattctcacaaagctcttccacatgctccattcggtggcttgaaaaaacgatggaaacgccgctgtttttcaaagaaatgaccgcttctttcagcagctcgacattcaccggatcaagaccgctgaaaggttcatcgagaatcagcagttcaggcttatgcaggacggccgaaatgaactggattttctgctggtttccttttgacagctcttctactttcttattcttgtaatctgtaatgccgaaccgctcgagccatgtcatgagctctttttccgcctcttttttgctcattccttttaatctcgccagatagacaagctggtcactcaccttcactttcggatacagcccccgctcttccgggagatagccgattttttcactgatggaataattgaccggcttccctttccaggtgatatgcccgtcagtcaggcttaaaagacctaaaatcatccgaaaggtcgtcgtttttcccgcgccgtttgcgccgagcagcccgaacatttccctttcaggtatttgcaggttcaaattgtcaacagcggtaaagctgccgaatgttttcgttacgttttcaattgtaagcacgaatccaactccttccttgacccattatatactaataatgggtaaaaattaatggaggattttaaattctttatcagaatatcattctataaagggggtgacatgatgggacaatatgtattgaccgcattccatgcgtcgggagaaacgctgctgaatgaacggatcgaagcggataatgaggcggaggcgaaggccgccggagaggctttattgaaggaaaaaaagcttgagaacagtactcatcgcttggtaaatgaagccggaaagctgattttattccacagataacagaagctttccggcttctgtatgttaccggttaaattgcggcgtccgtttttctaaaaaggcgcggatgccctctttatgatcatccgtttttctcatattttcctgggcctttcgttcaagagacaaaacgtcttttaaccggctgatatggaggctctgataaatagccttcgtttcaatcatcgctgacagcggcgcatgcagcaatcggtcgatatacggttgggccccctccgcagggccgccgctgaacagcccgtcggcaagcttgagccgcaccgctttttcagccggcaatttttcaccgctccaaatcagttttttcgcttcgatctcaccgacgcgtctcattaataaataatggcctcctccatcgggaaccaatccgatgccgatgaaattcatcgcgaggcgggcgttttcttcggcgagcaccacatcggcgcacagcgcgaaactcagcccgagccccgccgcggctccgtggatggcggctatcacaatttttttcatatcatagagcgtcagcgtaatggattcgatcattttcatgagccgttcatattctcccgaatcatgatccgacgtcatcatctgaatatcaccgcccgcggaaaatccccggccttccccccgcaagaggacgataagcgcttcgctgtcggctgccatcacgcatgcgttttccaattcccggagcatttgttcattcagcgcgttgtaactgtcaggccggttcagcacaatctctgcgatctttcccttttcttcataacgaatatactgcatgtttacaccctccttgtatccgcttacatattttgttcaaatgatatattccttccgccgaagcgaaactcctttatttttcaaggtcaatagataccgaaaaatgcatatcatttgaaactgaacatacatttttatatagtgaaattgatatacaaaacaaaagggggaaaaacgccgataatgaaatatgtgatactcagcttgttactgagcttttttatggtgctgttccccccttcggatgtcgctcttccttcccaattggtgacagaaacagacagccatgtacaaatttcggtttacccgcaggaaacggattcggcaaagacgccggttcacaccaaaaccgctccgcaaggcctgtcaaaaggatacggtgcgttatcccggatgatctccctgttatctgtcaaacctcttgatcaattcattgattccacaatggaaaggacatgcgccattccgatacaataccagtcaaattacctccggcatcagaccatttctcattgccaatctgtatttacggtgtaaaaacagtatattccggagggattttttatgaatattaaagaaaacgatctgcccggcatcgggaaaaaattcgaaatcgaaacgagaaatcatgaaaaaatgacgatcatcattcatgatgacggcaggcgggaaatttacagatttgatgaccgcgaccctgatgagcttctggcaagcatttcacttgatgatgcggaagcaagacagattgccgcgattatcggcggtatggtgtataaaccgcaggcgcttgaatcgattgaaatggcgttcaacgatctgattatcgaatggtttaaagttgaaaaaggggcaaaagcggcagggcggacgctcggcgaactggatgtgcggcagaactatgacgtgacggtcatcgccatcattaagcataaccggaaaaagcttttaaacccgggcgctgattcgctccttgaagcaaacgatacactcgtcctctcaggtgaaagaaagcatctgaaaaagctgatccaagacttcctctccagagacggagtgtgatctgtttatggaccatctcgtatttgaagtcggtacggcgttagttcttgtagccattgcgagtgtcatcgccaataaaattaaattctcgatcatccccttcctgatcattttaggaatgcttgtcgggccgcacgcgccccaagcgggcatcattgacctgacgtttatcgaaagccgggaagtgattgaatttttcggacggatgggcgtcctgttcctcctcttttacctcgggcttgaattctcggtcggaaaattagtcaaatccggacgttcaatcgccgccggcggaacgatttatattctgattaatttcagtttagggctgatctacggctttatcacgggcttttcctttttggaagtgcttgtattggcgggcgtcatcacgatatcatcaagcgccattgtcgcaaaggtgcttgtcgacttaaagcgcacggccaatccggaaacggagctgattctcggcatcattatgtttgaggatatctttctggcggtttacttatccgtcgtttccgggcttgttctgggagacgcgacgtctgtcggaggcgcgctgatgtcaatcgtgatcgctttcggatatatgctgctgtttttcattgccgctcgaaaattgccgcctctgctgaacaagctgcttgatatccgttcaaacgaggtatttgtcatcgtcattttcgccgcgctctttttcattgccggcttttccgaaacgattcatgtcgctgaagcgatcggcgcgctcttgctcggactcgtgttttcggagacggcccattctgacaggattgagcatcttgtcgtgccgttccgtgactttttcggggccatgtttttcttcagcttcggtctgagcattgatccgttttcactcggagatgcggtatggcttgccctcggcgccgttctgctgacgattgccggaaactttatcgccggcatgatcgccgggcgccgggcggggctttctcataaagcatcgtctaatatcgggctgaccattgtgtcacgcggcgaattctccattatcgtcgcaaatctcggcatcgccggcggcctgtccgcttcacttaaacctttcgccgccttatatgttttgatactggccatcttcggccctttgctcacgaaagaatcgaagcggatatatctcctgttgaacagcgtgttcaaatggaagacgcctgaaaagaagccgcagaaatcataaaaaaaagctgacctcttcataaggggtcagtttttttgagcgggaagaaattgctgaaaagccgtttttttattaatggagaaatgctcttttcccagaatggtattgatgattttttggtttctgtaaacagacagcttcaaattcgtagcgcccgttccgtgagcatgatcaagattcgttaatgtgaaaaaatgatgccgcctgtcgtccttaaagacaagacgggaatcggccgtcactttaaagcgtttctcatcctcccattcgatatcgggggcaattgccgtaaaccattccggaatatgaggtttaaagccggtcgccaaaatcactttttctgaatcggccgtaaaggtttcatccatctgccattgatgaaagctcagtacgcagcgcccgttttgcttttcaattttttcaagctccgccatcggctgaatatacacgtcaggcgaacctccgctgatcgatctgtgatacagggcatcgtaaatggcggcaagtgtgtcagaatcaatgccgtggcgcagtccgtccagctcagggagtgtgttcagccgttctttaaaaggcaggcggttaaaatattccacataatcaggtgtaaacatttcctgtccgagcttggcggtttccaattctcggaatccggcggagcgtgtcacccattgcagccggctgcggcggtattgttcatcgtgcaataagtcagaaaagatctccgcggcgctctgtccggagccgaccactgtaattgattcggcgctggcgagctcgtctttccgaaacaaatattccgtgctgaccatcgtgtcctgacgcgcttcgtcagcaatctctgcgggaataagcggttcagcccccgttcccatgacgaaatgcttcgtttgatagacactgatgcttccgtcctcaatgttcttgacgctgacgtcataatgtccgccggcatttttcacgccgattacctctgagccgaaacggcatgatttgatttctgaagccgcccagctcaaatagtcgttaaattcccgtctcggaatatcaaattcattaaacgtataaaaccggtacagccggtcatgttcatggagaaagtttaaaaacgtgtagcggcttttcggatcggcgagcgtgaccaggtccgccagaaacgccacctgtaaatccgtccctttaattaatagaccgggatgccacgcaaattctttctttttatcgaaaaaaagagcgtctgttccgggtatatcctctaacaatgcggcaagccctaaattaaacggcccgattcccgctcctatgacatcatacatattatgcacctcttgcgaataacagtctgatggtcttttcccgtttttacagacggttaaacataaaaaaacggcacgctgattccgtgccgtttttgatattataatgcagatttgacgaacatctcatctaagtatttgattttctcttctgtataatgctcgaatcggtcattatatgatttcgggtctttcggattggcgaagtgcgtgatttttccggtttccggatgaatgaatttgcttgccgcgccgcagccgataccgataatcgtctgcacttcttccataatcataatgttgtagatgctttcctggccagggaaggagtagccgacattttcaaggtttccgagaatgtttttctgccggtacaagtagtacggcgtatagccgtgctcttttgtccagcggacggcgtcatccatcatgcgggacacttcctgtctgtcggcaactttatacttatgcttgtttctcgtcatttctgacgcccgtttaaaagaaagcgtatgaacggtcaaagattcaggcatcagcttttccgtttcctcaagactgtgcctgaactcagccgtcccttctcccggcaggccgatgatcaggtccatgttgatgttgttcatgccgtgtttgcgggaaagatggtatttttcgatggtttcttcaactgtatgatgtctgccgatggccttaagcgtttcgttttcataagattgcgggttgatgctgattctgtcaatcttatacttatttaaaacggccagcttttcctccgtaatcgtgtcgggtcggcccgcttcaacggtaatctccctgatatccgcgacatccgggaaagagcggaccatttcttcatataaaagatccatttcctcagcggtaatgcttgtcggcgtgccgccgccgaaataaatggtcgtcactttgatatcatgccgcttcagccattctccgattttctgcatttcatagtgaagcccccataaaaaggagccgactcttcccgcctgtccttgaatggcataagccggaaacgtgcagtaggcgcatttcgtcgggcagaacgggatgccgatatatatgctgacttcatctttgacccggtacagatcgggaaccgcagcgagctggcggtcgacgatctcctgcatcagattgattttttcatcatggatcagataatcttttttcagatcggcgtgcgcctcttcttttgtcaggccgctctgcagctttttatgaagaagtttagtaggcctgatgccggttaagattccccatttttgtgtcatgcccgtatgcgattgaagaagatttaagtagacgtacgacagcgtgtttttcacctgtttaaatacttctttttcgctccatccggcaagaagcggtttcgtatgatgttccttttcgccggttcctttgatttctccggataccgacacgctgtctgcatcttgagaaatggcaagtgagatgacgagatcagagggttcctccgtttcgccgtacgcaagaacacactcttcaaaaaataaattcgcgatgttttgcagcggacgatgcagcctgtcatccgtgatgccgtctatttttatttgcaatgtgatcaccttatttttcagattcaaaactttctttagtgtacagaaagaacaggctaaaatcaatccgcgaaaaagccgcagaccggcgtttcgcgtctgcggctcttgattacggccgtttcatatggaacttatcgagaaagcctttgcggtgctgcatgcggaaatattccttaatcatataggcgactccctgttcatcatttgaccttgtcacccaatccgcttttctttttaattcatttgaggcattccccatcgcgacgccgagaccggccagctcgatcatcggcagatcatcttcctgatggccgatagccacaacctcttccattgaaagcccgagatcagcggcgaccatcgaaagtccgctttcttttgaaacccctttaggcacgatgttcagtttttctccgttgacgcggatcacatcgacggccgggaatgctttcattatcgtatccgttatatcagcctgcaggccatcttcggcatgcacttcaatgacgggcgctgaaaccggctcatcaaggagcaggtcacttaatgattcgacaaactgcaccggataaaaaatcgggtcagacggatgaatcatcgttttcccgaccagattggagttcactttcttcttgtttccgatcgaatatttttcgtgaagaagccggatattacatggatagctttccagcacctgaacaatattaaacgtgtgatcttctgatattttcttttcaaaaaacggctcatctattttttcagaaatgtatgcgccgctgtgggtaatcaattttgcattcagctttaatattttcgccactttttgagcagagcgaaaatggcggtttgtgaccagtgtgacgtaaattccttttttcttgacgtattcgatggcatcctttgtcgtctgatgaagtttgccgttggagcgaagaagcgctccgtctatatttaacgccagcatttgttttgacacagagaagtccccctccttgatgactgtacttgtcattaggatatgaccctgtctctttgtttagaacaaccttttctccgcagcaaaaaagcctgcctcaagcagactttgaactgtcgttttgttgggatacgatcgatttgctgccttctccccaatgtgtatttctatttacgaaatatatcaggaaccccttatttgaccgttgatgcgctcgtttcacttactctctgttgctaccccttatcataccaggcagtataggcgaccgtatccttagatcatctgtaagtgtaggcgctttcagagttattatctcaattatattgttaaaaaacaagggtttttttaactaaaaaaatcagaggaaatatctatgctgaatgtatgataaagttgcaagggaacatacattctcatataataaaagaaaaaaagcggtgactgtcatgtctctattaaaagatatttataacgaagaatttgcagaagcacttctgaacagaatcaaatcggcatatccggcttttgagcgggacaagtgccgggcgctgatgtttcaggaagattggcccggactgacgttaaaacagcggatgcgccggatcacagactctttatatgaaacactgccgaaggattacatacgggcgcttgacgtcttatatgagacagctccccgcttctcagggctcgccgggattatttttcccgattatgtccaacagtacggaacggatcactgggacgaatcaatgaaggcgcttcagtatttcactcgtttttccacttccgaatttgcggtccgcccgtttatcaggcttgaccgggtgcggatgttcaaagagttcctttcctggacggagcatccggacgaacatgtcagaaggcttgccagcgaaggctcaagaccgcgcctgccatggggaatctccattccggctcttcttgaagatccttctccgattctccctgttctggaccgcttgatgaaggatgactcgttatatgtcagaaaaagcgtggcgaataacctgaatgacatctccaaaacacatccggatcttctggcagagatcgcagccgagcggttcggcagctgtccgcacacggactggattttgaagcacgcctgcaggacactgttaaaaagaggagacaaacaggcgcttgcggttttcgggtttgaagacgcctcccggatttcattggaacgttttacactgaattcggaaacggccgccatcggaacaagcatacatttttcttttcagatccgctcatccgcccggcaaaaagtcagggttgaatacgcgattgattttgtaaagaaaagggggcaccgcagccgcaaggtgtttaagatgtcggagtccgccatggataacggagacgtaaaaaccttcagcaaacatcattcccttaaagatttaaccacccgcaagcattatcggggaattcacactctgtctgtcatcattaacggtacggtaaaaggttcgcttgatttttctgttgaataaaaaaacccctccatttcatagatggaggggtgtggagcttattccgggctgccgtaaagctcttcaagaggtttcataatgattttgtttaactcgccgatcagcatgctcatgcgctgttccgcttccatcagctgagaaatcaattcatgctgctgtacgagagcaaccgttttttgtgcctgctctacttcttcctgagtgatttcttcacctgacatctgtttctgctgcagctgcagctgtacattgcggaagttatcaaacatgcgttttgcggattcatctgcgtttacttgatcataaagccctctcagacggctgtattcatcactgtttcgcaaagctttttcaagatcatatgctgcatcataaaaatgaactgccatagtaaccgctcctttcttcctttcggacataccactccactataacagactgcggagcgactttcatcatcggcgtatgttttccttagaaaagaatgacaaacaaagcctgaattgctccgattatcccgccgagcagaccgcctaaatacgttatcatcttaaattctctcttggaaatcgacagcaccatttcctccagccgttcaacgggaaactgatcaacctgctctttgaccacttcctcaagacgcagccgtttcagcacatcctccaaatgagcggcaatactgccgagtgccgcatcaagcagcttcggcgcgtacgttcccgtaatctccccttcataacgggagatgatgtcaccgagccggcattcgaaaaagggcgcggtttgaagtgcggccaaaacccgctttttcatgctgaacagcagatctttcgcattccacttttcatcggcctcataaagtgtataagatttgagcttgccccattcttgagaaagcagatcagccagaagctttttcgtttcctcattgcgcaaaaactttaacagctcaggcagcacacggtctgccaagcttgaattgccgaggaacatctgcaccatgctgccgagcatcccccgggaattcaaaaagtcgtcaatcatatttccgagcctgtctttcccttcttcgctctcaaaataatcaatgctccgcttcagaatataatctgcggccaacgggactttttcatccagcttttcctgaagctcatcaggaagccagtcttttatggcgcggtgctcatatttccggtacagttccgaaagcttttcatcggtaaaacggtcaatccaggcatccgtcttttcctgcggattccggatgcccgcggcggccaaagcttcgtgcaccgtcatctcggaagcggccattttttgtgtgaattgttcggcgaaaagaagcgcctggtttttaacggtatctgataaaagccgcttttttattccttccggggttaaaaggtggttcgtcaccatgagccccatttgttttgccaattcatcccgccttttcgggatcagccccggcgtaaacggaacccgttttccgaacaggtaatacggccggtacggacgaaataacatctgaatggcaagatgattcgtcaccgcgccgatcgcggctccgatcacaatcataaatagaaacgttcctgctatgcccattccttttcttctgcctccatcttatgttctattttcttgatgatatatctattcgtattatagaggctggcgggcatgcgggcaaatgaagaacctgaattgttgtttgtgaggaataaggcaagatgctgtttcgtactctttacagtagatcatcttttataacgcgcttagcatatttattggatggaagggccgttccatcagcggctttttgaataaagggggagtaataatatgacaacactcggttttatgtctgtatcccgccggcacgaggaagattacgccggggaattggctgaaagagcgcctcaatataatgtgcgcttagcccgctttacaccgtttgatatatttccggattctttgcgcgtgaaagcgctcgtctatcacccgcaaagcggaaagtggaacgaaacggaaatcgatattcccgaatatatttacgaccgctgtttttacggaaaatccgctgaagcgcaaaaagccaaaccgatcgtcgaatggctgaaaaaatatccgaaaacggaatttatcggccgggggcttcctgataaatggacggtcacggatgcgctccaaaagcatcatctgatcagtccctatattcctgaaacggccgaagtcagccgctatgaacaggtgcaatcatacttagccaaggaaaaagcatgtatacttaagcccgctttcggcgcgggaggcagaggcatcatcctgcttgaaacaggcaaaaaatcaattacggccacttactatatcggaaaaaacaaacaaacaaaatcattttccaatcacgtgtcttttaagtcttggtgcaaaaaagtgctgcagcaccgctatttgcttcaatcctacttaaatatccaggataaagagcggcatccgtgcgacatccgcattttcatgcgcaaaactgagtcaggcgtttgggaaacggtcggaaaagcggtcagaaggggttatcagaacggtcttttatctcatttgcccggaggatccgaaccgattaagtttgacacatggtttgaggaaattccgagaaagcagcaggccgttttattggatgatgtcttttcgatcacccaatccgtcccttatttccttgatgaacggttcgggccgctgtttgagctggggctcgatatttgttatgccaaagacggacgcatctggcttttggatgtcaactcaaagccgggacggaaagctattttaagcgtggctccggaggcgaaagaggatttgtatacgagtccgctgagacgcttccgcgaacttcagtcacaggaaagccggaaaggagtattaccgcgtgaatcataaagggatgattgtcggcatcgataaaaaaagcaaaaatacgctgtttctcccctcctccatgaaacgggaagggcttttatccgctgccttcgggaccaaggttgtcaaatgccgtgtagccttttctcaatcacttgaaaaaagcgcgctcctttctgaagatttgtttgaggagctgttgataccgcataaaagccgggctgactttctcatacacggccagacggtgcacatcggaccgctgatcggcgttttcacagccgggttcacatcatcgccgtcccgcccgttaagagaccgtacagccttcttttccaagatgctctctcttcatgaacaggcgaacggatattgtttcgttttcggggcccatcagatcaactgggaggaaggcaccgtccaagcgctgatttataaagaaaacagctggaaacggacggccgtcccgcttccgaatgtcgtatatgacaggctcccgagccgaaaaacggaagaagttccgcttttacagcagacaaaacaaaggctgatgaatgactatcagattccatggtttaatccgcaattctttaataaatgggacattcataagcttctggaaaaaaacagtctcaccgcttcacttctgccaaaatctgtcctgcacccgaatgcagaagcgttagaaacgttatgcagcacgtttgacaccgtctatatcaaacctgcagacggcgcactcggaacggggatttacaaggtggaaaaaacagatgccggcttatctgtcaaacacacgaatgaggaaaaaacggtggtgacggcagagtattcagatgcggcatccttcatgacatcatttaaagaaaacaatgacccgtccgcatttttaattcagcaaggcattgacctgatccggctggatgggcgccccgtcgatttcagggtgcacacgaataaaaacgccgaggggaaatggacagtgacggccattgcggcaaaaatttccggtgaaaacagcatcacgacgcatctcgcaaccggcggagaagtcaggacgttagctgaattatacggcgatccgcgagagagagtcggcatgatgcggaaactttcaaaagccgccttggcggtcagccgcgtgttaaatgagcacattgaaggttttatcggcgaaatcggttttgacctcggcgtcgatcattcagggaaagtttggatgtttgaagccaattcccgccccgggcgcagcattttttcccatccgaagctgagatcggtcgattacctgacaaaacggagaaattttgaatacgcgtcgtatttatcagaacggtccatcaccgccccggaaaaactttggcggtgaggctgtctttttttaggtttacccgggacaggcattgaacgatgagctacaatgaacaagatcaacatttcccataaggagcgtgaacgtcatgatttcgcacttcagctggaaaccgttattcaaaaaagagaaactgcccggatggcggatttcattttactggcagggtacgcattacgaagggatttatcataagtccggagacattgaatggggacacacacatccgggaaaagaagagccggctctcgtaaaagagctgcatgaattaatgctttatcacatatatgactgaaagctaaaagctcagccgcaccaggctgggcttttctttttccttccgctatttaccacaccgttttccgaatgagatgccgtttgattcaccataatacgtagtacaaagcggcaaacagcattgggtgaagccgagctggcaatggttttcattccgaaaaccatcggctggtgcaattccagcaaacccaaccatactactttataaaggagatcatacaaatggcaaacaacaactcttcaaacaacctagtagtacccggcgctgctcaagcaatcgaccaaatgaaatacgaaattgcttctgagttcggcgtaaaccttggcggagaaacaacttctcgtgcaaacggttctgtcggaggagaaatcacgaaacgtttagtatctttcgcacagcagaacatgggcggccaaggcgtacaataactcaataaatggcttacagaaggcgcgggataccgcgtcttcttttatgccgtcacccttttttcctattccacataccctaggaaaaaaggagggaaaacatgtcattcattgcctcagtcaattgggagctgtttcagttcgtaagtgtctctttggtcaatgaatatgttgcccaccatttcccgtttattcacaggtattcttttccccgctgctttgaatgatataatgagcggcgaggaggttttttacatgaacatcgctttactcggagcaacaggaagagtcggacaggcttttataaaagaagcgcagaaacatggacacatggagatattcgctcttgtcagatcagccggaacagtccttcccattcctgaaaaacaaatcataacagggaatgcgaggcggcgggaagatgtaagccgattgatttccaaagcggacacagtcgtgagctgtctcggcacggacggtgacgataccctttcagccgctatgacccatataatagacagcatgaaacggcatcatgttcagcgtctgattacgatcggcaccgcgggtatccttcaatcacggcttatgcctgatcaataccggtttgaatcggcagaatcaaaacgaaaatcaacaagagccgcaaaggaacacgcccgcgtatacgaaatgctgctggcagaggatcttgactggacgatcatctgtcccacctaccttcctgacggagacgctgccggagtttaccggttcgaacaggatcgccttcctgaagacggcgctgaaatcaccgtcggagacacggcgcactttctgtaccgtgagctgatcagcccgcagtttgtcagaaaacgggtgggactggcttactgaatgaaaaaaagggcgaatctttagattcaccctttccgattacaccgcggacttcgccgttcctttctgcaattcatacatttggtggtactgccccttttgcgccattaattcgtcatggcttcccttttcaataatgcggcccttttccagcacgagaatctggtctgcgtgtctgatcgtggaaagccgatgggcgataataaatgtcgtgcgcccttcttgaacgacttgcagcgctttttgaatgactgcttctgtttcggtgtcaatgtgcgccgtcgcctcatccaaaattaaaatggccggatcgaacacaagcgctcttgcaaaagaaatcagctgacgctggcctgaggacagtgtgccgcctttttcggtaacgggctctctgatgcccttcggcaaagattgcagaagacttgcggcgccgacttggcgaagcgcttcttccgcctgctccaaagaaatacgctgatcatcgagtgttacattggagccgatcgtgcccgagaaaagatacgggtcttgcagcacaatgcccatatgcgacctcagctcctgcctcgacatgccgtatatgcttttatcgtccagcaggatatctcctttttgggcatcataaaaacggaacagaagattcaggatggagcttttgccggaccctgtatggccgacgagggcgaccgtctcccctttttcagctgtaaagctgatctgtttcagcacctcttccccctttcgatatccaaaagaaacatcgcggaattccactgtcccttccgcctttctgtctgcgggagcgccttcttcttccgtttcctcctcctgtaaaagctcgaataccctggcggcagagacacgggccaattcaagcttcgaaaattggttgacaatccccgtaaccggctggaacaaacggtttaaataatcaacaaacgcgtataaaacgccgatcgaaacaattccggccgcactcagactcgcgcctccgaaataccagatcagcccgacaaacgccagattgcgcaacacattgacaagactgtgggacatgagggaatttaaggacagcattttgtttttgtagcgaaaatgagcttcattcaattcttcaaattccttcatcgtttccttttcgcggcggaacgcctgaataatcggcattccttgaatggattcgttcattttcgcattgatgttactgttaatggaacggattttttggttgaagacggatgcgtatttgcggtacacaaccgaccagatcattaaaatcggaataatcagcaggcaaacggcggccagcctgacgtcaagcataaacagcgccgtaaaaatgccgagcatataaacgccgcttgtgataaatgtcgacagcaccgttacatataaatccctgaccgcttctgtgtcattcgtaatgcgggccacgacttttccggcaggcagattatcaaagtagcggatcggcattttctgaatgtgtgaaaatacatcctgcctcatgcgctgtatgatccggttcgctcccatctgcagcagataatgctggccgtaatgaaaacatacggaaaacatgagcagtcccgcgtaaatggcggtcagcgtcagcaatccttttatttcgggacggtaaaattgaaaaatctcctgtcttgataacgtaatggcgggatatgacctgctttctttaccgtttgatattgtcagccggccgtcagacaccgaacggtttccgtcaaaactgacgggacggtcaacaaaatagtagcccgcaccgacttgataaatgtgcgcctctccggttttgtccgcccccggtttgagccggtcctccctgacataatcatgcccccggaacctgacggcgcccggatcgtccgcagaggctttaacccatgttttttcaatgccgagaatgtggtcgtcaatcattttttttccgataaacgggccggtcagctcagtgccgaccgcaataatgagcaggacgaccgcccatatcagcagcttcttatattgaagcgcgtaattccataatcttctcccggtcttcatgcgcccgtccccccttcttcaagagaggacagccgctgcctctcatattgttttcgataccagccgttctgcgccaacagctcccggtgcgtgcctctttcagacacccggccttcatccatgacgagaatgagatctgcgtgttcaactgccgagagccgatgggtggtgataatcgttgttttatgccgccgttttttacggatgctgtcaatgatggcggcttccgttttcgcgtctacggcagaaagcgaatcatctaatatgagaatgtcaggatcggtcaaaagcgctctcgcaattgagatgcgctgcttttgtccgccagagagcgctacgcccttctcgccgacaagcgtctcaagcccgtcggaaagcatgccgatatctttttcaaaatgcgcatctttcagcgcgctgccgatttcctcttcgtttgcatcctgccgtccgtaaagcagattctcttttacagtctttgaaaataaaatatgatcctgcggcacatagccgatccacccgcggagctcctcaagcggaatctcctgaatcggaacgcctgtaaacgtgattgctcccgcgccgggcggatattcacgcaacagctgcttaatgatcgtcgtctttccgcttcccgtcttcccgacgatgccgagtgtctgccctttttctacggaaaaagatacatcagaaaccgccggtcccgctccgctcggatacgtgaaagtcacttgttcaaaaacaagacgcccgggctccttgatgccggcggggtgcttgggtcctgtcacgtctggctcataggaaagcgtctcattgacacgatccaaggaggcatttccgcgctgcatgatattgattaattctccgatcgcaaacatcggccagatcatcattccgagatacacgttaaacgataccagctctcccagcgtcagccggttttgaaaaacgagataagcgccgtagccgagaccgatgagatagctgaggccgacgagaagtttcacagtcggttcaaaaagtgaatcgataaacgccaccttcatgtttttctcatatacatccgccgtcatatcaccgaaccggctgacatcatttttttcctgcacgaaagcccggatgacccggacgccggataccgactccagcaccttgtcatttaatgatccgaaagcatcctgcgcttccgtaaaccgctcatggatcttttttccgtacaggctgaccgcagccgccattatcggcagcggaataatcgcggcaaatgtcagcttccagctgatgagaagccccattgtcaaaaatatcgtcagcatatacatcgtcgaatcaacgagcgttaagaccccgaagcccgtcgtcatactgacggcctgcaagtcatttgtcccccgcgccattaaatcgcccgttctgtatttctcgtaaaacggcggtgacatttgaagaagccttcccatcagctttgaacggagaatcttctccatgacattcgccccgccgaaaagctgatacatccaaaaataagacagtaaatagacggctgccgttaatgcgagaaaaacacatatgtaaaacagcatcccgctttttgtaaacacgcccgccttcatatcgtctatcgcgttaccgagaagtttaggcggaaacatttcaatgacattcacaatcaataacagaacaatcgctgtcgtatagcgcagccaataggctttaaaaaaccacgcgagcttttttaatacagtaaacaaataccgtcatcccctttcatcaatcagccgccctcaagcttttccggattgtttttcattgttttcgctaataccgccacatgcatcacacctgtctttctttcatttttttgtataaaaaaagacatgaagcctcagctccatgcctcttattattataaataaggtacagacccgccgtttatgcgcgactgccccgtttttaagcaaatgttcagaaaacggaagctgtatgggagtcacgccggtattcagctgaaaatgagttgacaagctttagttttgacatgatccatacctcctttttccctatattgttccttcatcatataaacaaatcctttttttgtcaatgcaggttttacatttctgccattcgggtattgtaaaacaaaccttttttactgaaaggatgaggccgatgtttcatgcggaccggttgatagcagcttttgacggaagtgatgatagtaaaaaagcgctccaaaaagccatagacctttcaaaaacatttcacgcggatttaacggtcgtacattcccacaatgcaaaagatacccggacgattgttgatcccccgaggccgggagccggggcaacgtatatcggcggcgggattgcaagcgttcctgacccgctccaggcggaaagaatctcccctgatccgatgatttatgaagaccgtacggaagaaatcgttgcggaagcgagaatgctgatgaacgacagccagattgacggggatatcgacattttagaaggtgatcccgctgatgccattatcgagcatgccgaccgtatatcggcggatttgatcgtcatggggagccgggaccagaacaggctgaaaaaacttttattcggaagcgtcagtgaaaaactgtcatcgaaatccgatattcccgtgctgatcgtaaaataattctttctgtaaagcagcttaatcaaaagctgctttttttacagctcccggctgtttcttctttttttcggcatcacaaaaaaactcgccatgatcaaaaaatcgatgcacaatacgacagaccagccctttaacagcttgctgagcgcttcggtgcgggaagcgtcctgaatgagaaataccgttccggctaaaagaacgccgccgatgacaaacgctaatacatgtcttccccatccttttgcataatgtttggcataatccagcccgtaccgtttgaccggttttgccccttccttgaccacataatagcggaaccgctcatccgcccattgaatcatgcttttcccgaaggcgacagacactccgatataaatggccgccaccgcatgcgccatagtcgccgccgcccctctgtataaatcagctgcggccgccagaaacagtacggcatccaataaaggaatgagagcgaaaaaaaacattccgagcttttgccgcctgaatatatagcgcgccgccaatccgaagatgacagccgcccaaaaagcagcctcacaaatgacaatcaaccaagcaatcgcgttcaatccggttcccccttatcgttttctaaaatgcattgtatcactgctttttatttaatacaactgtattacaaaattgcaagaaaaaatatttcctgttacactggaaccatgcctaaaataatcgatcatgaaaaaagaagaaaacaaatagccgaagccacttggcggacgattttggagcggggaatggaaggagcgacagtgagaaacatcgcccaggaagcgggtctttctttaggcgcgctgaggcactatttcaccacccaggatgagcttttagggtatgcgatgacactcgtaaaagaaaaagcggccgccagaattaacgaagttgccatgaaagatctgccgccgaaagaaaaagcggtgcgtctgatgcttgaaatcatcccgacagatgaagaaacgatggctgaaatggaggtatggttcgctttcacagcttatgccagacataagggagaagagtttcaaccccagcaggacgggatcttagcatatatccgcggtctgattgactggctggatgaaaataagcttctgaaaccgaatcttgataaagagatcgaagcggagaaaatgtacgccatcgccgacggattggcgctgcatgccatgcttgaacctgagcgtctttcaaaagagaagatctcccgtgtgctcattcagcatatcgaatctctttttatctgactgaagtaaaaaggccggatgtgttccggccttttttcagcttatgactgaaccccgagctcctgctgaatgtgcgactgaaaagcctcctgaatcgttttggctacaggtcccggcgctccgcttccgaccggttttccgtcaagggttacgatcgggattaattcagccgtcgttgacgagatgaaaatttcatccgcatccctgagttcgtcttcggtaagagccttctcccgcacctcaatcccgttttctttcatcagctctaacagtttcatccgcgtaatgccgtttaaaatcagctcatttgcaggatgcgtccggacagtgccgtttatgacggcgtatacattggaagaggttccttccgtgaccgctccgtcccttatcagcaccgcttcataagcgcctgcttcataggctttttgtttaatcatcacattatacagtaaattcagactcttaatgtcacacctcagccagcgtttgtcttctgccgttatggcctgcgctccggctttttgttcattttccggttttttcactgaaaaggtatatgccgtcgtctgcggttccaaaccttcgtcatactggtgcttgcgcggcgccttccctctcgtcgtctgcatatagaccccgccgtcaatgagtttgttttcctgtacaagcttttgcagatcccattctatgtcctctgcggagaacggcagggtgatgccgatttctgcggcgcttctgaaaagacggtcgatgtgctcacgcagaccgaataaggcgccgttatacactctgatgacctcatacacaccgtcaccgaattgatatccgcggtcctcaatatcaactgccgcttcttcacgatcaatcaactggccgtttactaatgtcttcatgtaaaccctcctcatcgttatctgccgtgatgtgcattctcagctgttattgtcaactattctatcatactgaacgagccggctgcggagtttatttttttcttaaaatcttattattcgacatcttttctatgtcttttccagttttgttcctgtatacttgattcgacatacatatgctgttaacttatggcacttcgcaagcctccgctgttatcggcattatgcagaaacttatgctactggagagattgttatgcgcaacacaaaagaaggtgcttccccttctctgttttcattggcttttaaacttacgagtttagcagttttgtgcggactgcttctggtaatcgtcataatgggatattccgcttccgccgcaaaaaacaaacaggtcaccgtgaccgcaaacgggcagcttcgggatgaagcagaaagcctgcggctgaaaaatgattctcccgacgtcttaatgaaacatttgcagagagagcgtgacccagggaaaaaaacggtatatttaaccttcgacgacgggccgtctccatatactgaacagctgttgaatgtattgaaggcaaatggcgcaaaggccactttttttatgcttgaaccgcggatgaaagcctataagcattccgtgcaaagagcgaagcaggaaggaatcgcgctcggcctgcacggcgtgacgcacgataatcacctgttttatcaaacaccgacatcaccgctgaacgaaatgcagcagggacgcgatacactcgaggcaatcaccggagtaaaaacggatcttgtccgcacgccttacggcagtaaaccgtcattgacggatgcccagattaagaatctcgaaaaagacggattcgtgtactgggactggacgatagacagtgaagactggaagtacaaaaacgcacggtacgtgccggaagtattgaatcagctcgcatatttggaaagcgttcatacgagcaggccgcatgtcattttaatgcacgatctgcctgcgacggtgcacgctttgccgagcctgattcaaaaactgaaagcccagggctactcctttgatgttctgacggatcaaatgattcccgtccatgaataagaaaagccggatctgtatatgatccggctttttttatgtcgcggcgctgatccgttttgcaaattcaccgatcttctcatggatgacaagatcaaataaatggtcgcaatatgtcggctcaaggttaatgatcacctgcttcaaaccgggaatccgtcccgcatcctcagggacaaaccttgccggcgccacttcaagcgaagtgccgatcacaagaagaagatcagctttatcaagcttttcataaagggtttcaaaatgctgaacgagatcgccgaacagcacgacatccgtttttaatacggtgccgcataccgcatgatcaccgatttccgccgtacattccggcacttcgtccttcagcagatgagaaagcccgtagcgcgctccgcagcgggggcatgcggcggtctgaattgaaccgtgaagctcatagacactgctgcttcccgctttcttatgcagcccgtcaatattctgcgtaaaaatgtctacctgctttccccgcttttcaagatccgccaaatacgtatggccggcattcggctcatagcttccgctcattttcatctgaaagagctgtttgaatttaggccagaattcacgcggacggcgttcaaaggattccctgctcatcgcttccattctggaggtgtcttcggtccatataccgcccgccgaacgaaaatcaggaatgccggattccgtgctcattcccgctcccgtcagcaccacgatacgttccgcctgattgatcaatgtcataaacgcttccactcttccaccgccttttctttttatcatatcatgaaaaaagaacggcgcctgttatgcccgttctttttctccggaatgatccttcacatgaaccggatcatcgtggcttttctgttttacgaatacattctggcccggataggcgaattccacgccttcctcagcaaaaatatcaataatccggcggttgatatcctgccgcacgtccaggctttccgcccagacgatggtctttgtgtaaaagttgaaaaacagattgtaatagctgtccgcaaacacgtcaaagttaaccataatcgtatcatcatgcacgccttcatgttcacgaagcatttctctgagccttgtgatgcaccgctctaaacgatcaatcggcgtcgcataagaaacacgaacggaaaacgtgacctggcgcttcgtcatcctcgtccagtttgtaatggcttccatggacagcgttgaattgggcacggtaacaagcgccccctgcgccgtgcggaaccttgtgcttcggaatgtgatatcttcaacgccccccgttacagatgacgtctcgacccagtcgccgatcgtaaacggcttttccgtaatgatgataatgccgccgaaaaaattgctgatcgtatctttagccgcaagcgcgaaggccaatccgccaagtccgagtccggccacgaacccgtttacatcataattgaattcctgcgcgatcacactgacgctgagcgcgagaatgacaaagcgcagcaccttggataaaaacggcgccaaaatgtcatccatatcaagctcaaagcgctgattgactttatgaaataaaaacgaagacgccgatgtcagattgcaaagcccccaggcgatcagcgcaacgatcagagagcggtacaattttttggcaatgtccatctgcccgtctaaaaacggcgaatactcaatcgccaaaaacagacccagcgccacgaaaaaccacctggccggcttgtcaaacgctacggcaatctgtttgaatatgtcggttttcggcttgtttgccaatttgtaaatgagctgaaaaaagtatttgacaaacagttttctcaaaacgagaaaagccgctaaaattccgatgctgatactgatctgcaaaatatggtcaagagtaaaaaagctctgaaattgtgtcatcatggcatatgctcctttgtcttgtcgaaaatctattatactaaaacattcggacatcagcttcttttaatgtctttaggcagcctgaaaaaccccggcatcagagcacagccggggtttttcacacattcgttcatctttcagccagatacaacagggtcaggcactatttcttctttgattgtgtctgtttcaggagagtcgctttttggatttcagcatcggtttcggccttaattctttcttccactttcaatctcccttttcccatgatctcgcctcctttttgccattataaatcatcactgcggattgtaaaccgaaaaaagcactatctttattccaaaaaaatactgtttcgcacattcaccagtttgaatcgctgtgcatatacgaatctgatataataacagaaatgcccatgaggggagctgacaagcttgtataccatcgctcatcgcggcgcatccggttacgcgcccgaaaatacatttgcggcatttgatatcgctgccgaaatgaacgctgatttcattgagcttgacgtccagctcacaaaagacggccagattgtcgtcatccatgatgacaaagtcgaccggacgacggacggctccggttttgtaaaagattttacgctgaagaagctgcagtctctggatgccggcagctggtatggggctgagtttaaaggggagcggattcccctgctcgaagaggtcttgaagcgttatcattctgaaatcggatttttaattgaactgaaggggcacgtttctcaagtcggtcttgaaaaagcagtcggccagctgttaagcaggttttccttttccatccaccctatcgttcaatcattcagcctcaagtcaattcagacctttcacgacatgtatccgtccgttccgactgcaataattgcaagacccagcttcgggatgttttccaaaagccagctggccgcctacaaatcagccgtaaattatgtcaatattaaatatacccgcctgaatcggttcttgatttccaccgctcacagacacggcctgaaagtatttgcctggacggtcagaaatcaaaagacggccgaaaaactgcaaatgatggcagttgacggcattgtaactgattttccggattttatttctaaggatggctgatatgaaacaatatatcgcaatttttatcggaggcgcgcttggcgcattgctccgctttgaaatgagcgcgcacattcacagcggttctttcccggcggccactttccttgaaaacgcggcgggaagccttttactcggtcttattacgggttttttcatcattcgggctaaacgccctcttttgaccgcctttttaggaaccggtttttgcggaggtttcacgacgatgtcaaccttcgcaaaagaaaccatttttctgctgcaatcgtctcccgcagcggctttttgttatgctgccgcgactttattcgctggtcttgcccttgcatacgccggcattttctggggacggcgtattgcccttcacgcagcgggaagggggcatgatacgccatgacgatcgtcctgatgcttatcgcagcgggtatcggagcggtattacgttctcttttgggtaaaacaatttcagaaaaaacaaaaggttttccgatgccgcttggaatggctgcggtcaacctgctcggctccttcggcctcggcatgttcaccggcctgggcctggataatccttctgccggcatcatcatcgcgacgggctttttcggtgcgtttacgaccttttccacgttcagtattgaagccgtgcagctgatgatgaacaaccgcattaaggaaagcctgctctacatcgctgtttcagcagccggaagccttttggcgttctggtgcggctttgttatgatatccatgtaaaaaaaccttgagcttatttttcgctcaaggttgcgttatgaagcatgaccgtttcaggcacgggcagctggcggtttattgttccctgaccgcccgggcggccctgttcttctttgagttcaagctgtttaataaaccggccgtccatttctaatatgagggcagtgtatcccccgatttgtatcgactcacccgcacagatgtcaatattccgtttcagcacaagaccgccgatcgtgtcgacttcctcttcaatccctgcgccgagaagatgattcacctgatcgatccgaacctttccgtccagcacataatggcgttcggacagcttttgaatctgcggctgttcgtcctcatcaaattcgtctctgatatcgccgacgatttcttcaagtatgtcttcggtcgtcacaagaccggacgttccgccgtattcatcagacaatatcgccaaatgaatccgttctctctgcatttttatcagcaggtcgtgtatcgggatcgtctcgatgacttcaatcaccgggcggacgtaagacgtgatggatacttccgctttttcatcttctgtcataaacagcagatctgaaaagagatgcttcgtattgatcatgccgatgacactgtctttgtccccgtccgttacgggccagcgcgtatatttgtctttcagcatcatatcaagcatttccggcacgtccatatcagtggaaacagccgcgatttcttttctcgggatcatgatttccttggcgatccgattatcaaaatcaaaaattttattcacaaacgtatattcagacggattgatttctccgttttttaaactttctgacagcaggatccgcagctcttcttcagagtgggagccttcatgctcagatgccggctttaatccggccaaaccggtcagaattctcgcggagccgttcagcacccaaataaacgggaacatgaacacgtaaaataaccgaagcggtccggcaatccataacgtcagcttttccgctttttgaatcgcaaccgttttaggcgcaagctcaccgacgacgacatgcagaaacgtaatcagcccgtacgccgcagcaaaagcaatcacatgctcagcagaatccggcagccccatgccctgaaacacaggatgaagcatccgctcaaatgcaggctctcccagtacgccgagcccgatggatgtgagtgtaatgccaagctgcgacgcggataaatactcatcaagatccgtaatgatacgctttgcgagcaccgcccgtctgttcccttctgaaatgagctgatcgattctggatcttctcactctgacgatcgcaaattcactcgccacgaaaaatgccgttaacgcaatgagcacaccgattaaaatcaaactgtcaatatcgtccatttcaccttatcccgaattaaaggataaggacgtcacctcctgatttcatcgttttttcttaagcgagaggaacgaaatgggtgattgactacacagagggccccatcctgccacctcctaagtcaaagcatgattgtcatttgtatagtttattgtatcacaactccattctttcatcattttcagatttttatcatataaaaaacagccttcaaaaagaaggctgccgttatctgcttcggaaatgattttctaaacaaagcgccgtattaatccccccgaatcccatgcttaagcttaacgcatggtgtacggtatgggcgctcggcccgtcggtcacccactgaaatgaatcgtcaatcggctccgttaagtttcggatcggatgaagcttgttttcccgcatttgcaagagagcagcaatgatttccaccgttccggccgcactcagaccgtgtccggtaatcgattttgtcgcattaatccgcgcgtgcgacaggccgctttcagaaagcgcccggcattcagtcttatcaccgatcggcgaaccggtgccgtgcgggttgatgtaatcgatctctttcgctgaaaggccggctcgctccagcgcctggcggatcaccgtcatttcgccctctgctgaaggattcgggttgcggttcgcatcggaagccatcccccagccctttaagccggcccacgatcgtgcgcccctctcttcggcagattcagcgcgttccagcacaatcgccccgcacgcctctccgaatataaacccgtccgtatgccggtcaaacgggcggcaggcggcttcaggccgttcagcgtatgtatcagtgcccatcgctcccaaagaacggagagcatgacactccatgtacgacagatcggccagcgccccgatcacgatgcaccggtcaaacaggccgcctttgattccttgagcagcctgaataaccgccgcctggccgcttgccgacgcgccgccgaccgtaaaggccggcccttttatcccgaattgctccgtacaaagccccgacaaatcactatccataaaagaaagcccgtatgtcggatttacaaattgcggcgtttcaccgtttttctcaaaggcctgcagcaattcgcgctgcgtcatattcgagccgccgataatcagaccggtgcggctgtgatcagcgccgtctaattgagcgtcatgccacgcttcatataaagcgataagcgccgtctttcccgataatgcggcccttcggtacaagcgcttcgacagcgcgtccggcggcgttaattcgctaagctccgcgccgataaacgaactgcctttctgccggccgggccgtttcatcacatcaaaggcgtgccgcccctccataagcgcatcgagaaacgcctccttgccttgtccgaccgcggttaagactccgattcctgtaatgctgatgtctgacgtgccattattactcctcgacatttgtccgttctcccatctttatgtattggaagctatgaagaaaaatcttgatacagtgctttgaaaatatcgcgcgactgtctgatctgttctgaaggcacgctgaaagataatcggaaatagccgctttttccaaatccgctgccgggtacgatcaatagtttgtatttctgtgcggcatgcatgcagaacgccacctcgtcttcaatcggtgatttcggaaagacgaaaaagcctcctttcggcatttcaaattcgaagccggcttctgtgaggatgtccaccataaggtctctccgctttctgtaaggttcagcgtcaatcgaaagatcatccattttcgccacggcgcgctgcatcatgaccggagcgttcacaaagccgagcgtccggttgcagaaaacgaacgcatccgtcagaagatcgccctcaggcatttgggcgtctgccgcgatatacccgagcctttcccccgcaatgccgagatctttactgaacgaactgactaaaatcacgcggtgatacgcctgaaacggattcgcctgctcttctccgtagatcagctggctgtacggttcatcaaataaaataaatatgctttggccgttccgctcttcggcttcttttaataaggcgcccaattcgttaaggtttttctggctgagcacagtccccgtcggattatgcggcgtattaacgatcagtcctttcgtacggggggtgatcgcacctttaaccgcttcaatgtcaatctcaaatgagtcagtcagcgggcagatgacgggtctgccgtggtaattttcaacatacgctttatattccgcaaaataaggcgaaagaaggatgacttcttcctcggggtttaaaatacttttcagcgcgacattcagcgccccgccggctccgaccgtcatgactgtatacctggcggaaatttctgtctgaaaccgctctgacaaaaagcgcgcaaccttttctctcgcctccggaagcccctggttttgtatgtatccgtgccgccctgtttcagccgcttcgcaaagcgcctttttaaatgtttcaggcggctccgcaaccggatttcctattgaaaagtcaaacaccttatcggcgccgaactcttttttcagccgagcgccttcatcaaatagtttgcgtatccatgaacctttctccagattctgtgtcacttcccgtgataaaccggccactgtcatctgtcccttctgtctttttcttccgtttctatttacaatgattatgaaagatttacatggcgcagtcaacgctttttcagacagcccgccgcgccgtttcaggagaaagacggaaaacaataaacttgtgcaaactccccttcatatattaaactattctcataactataacgtgatggttggggagggatttagatggggctgagacttatcgcatcagtgaattagcagagcttgccggtgtaacgaaacgcacggtggattactacacaaacctcgggcttttaaagcctgacaggtcttgttcgaactatcgttactacgatacacttgcacttaatcggttaaagtttatagtcgcttgtaaaaagcagcgattggccctgtctgatataaaagatcgactggagaaccagtttccctcttcagccctgcctgacgatattggaaatctggcatcggaaattgatcacatgaatcaaaacatctccgtgatcttgaatcggtttgaaaagcttgaaccagaggagcgcgcccagctgaaaaaaaggctggctcctgaaaagcttgcagtgcttcaatcatttatgctgctgttaagttaaaccattatcttactaacaggaggtgttaccttcatcttcccaaaagaagtgaaggttctaattggacattgtgaatttgattttagtcgcggttttaatcgcgctgacggcatttttcgtagcatctgagtttgcgataatcagaatcagaggctcacgggttgaccagcttatagcagaaggaaataaagccgcaatcggtgtcaaaaaagtgaccacgcatttagatgagtatttatcggcgtgccagctcggcataacattgacttccatcggtcttggtgtcttaggcgaatcaacgattgaacgcttgcttcatccgcttttcacaaagataaacgtaccaagctcattatcgcatattatttcatttattctcgcctatgcgatcattacattcttacacgtggtcgtgggagagttggcgccgaaaacagtcgccatccagaaagcggaagccgtttcaatgctgttttcgaaaccgctcatttggttttaccgcatcatgttcccgtttatctggcttctgaacaactccgcccgtcttttaacgaaggcgttcggtcttgagacggtgtctgaaaatgagcttgcccactctgaagaagagctgcgcatcattttatcggaaagctataaaagcggtgaaatcaaccagtctgaatttaaatacgtgaacaaaatctttgaatttgacgacagacttgcaaaagaaatcatgattccgcgtacggaaatcgtcagtctgccgcatgatatcaaaatttctgaaatgatggacatcattcagattgaaaaatatacccggtaccctgtcgaagagggtgacaaagataatattatcggcgttattaacattaaagaagtgctgaccgcctgcatcagcggcgaagtatcagtcgactcgccgattaccgattttgtcaatccgatcatccatgtgattgagtcggcaccgattcacgatctgcttgtaaaaatgcagaaggaacgggttcatatggcgattctgtcggatgaatacggcggaaccgcggggcttgtcaccgttgaagacattattgaagaaatcgtcggggaaatccgtgatgaatttgatatcgatgaaatcaacgaaatccgtaaactcggcgacggccattacatgcttgacggcaaggtcctgattgatcaagtgaacgaactcctcggcatccatttggaaaatgacgaggtcgacaccatcggcggctggttccttacccagaaatacgacgtcgaacaatacgactcgattatcgaagaaggctgtgaatttatcattaatgaaattgacggccaccacgtcgcatatatcgaagtgaaaaaactggcgtttgatgaactgctggaaaccgccgaacaaaaagaagcataacaaaaaagcttgcgcgtctgatacagacggcaagctttttttcatttacagttgttcaagttttttctcaagctctttaattctggcattcagctcttctgtcatggccgcaagcctctccttcggcgcaagatcggaaaagtcctccaaaaaaatcggctcgccgatgataagccgcatttttccctttttaaacagcgcttttcccgtagacggccctttatatgcggccggaacgagcggcgcttttcccatttgggcgatggtcacggcccctcttttcagcgggacgtcttcagatgttctcgtgccgctcggaaaaatcccgacaatctttccttccttcagaagcttaatcggcgttttaatgctgcttgggcccggattttcacggtcaaccgggaatgcgtgaatcttcttcaaaaaacgtccgatccactttttctgaaacagctcttttttcgccatataatgaatctgaaggggcaatatcccgacaccgagcgtgaggacgtccacccagcccgcatgcgtgcacgcgataacgaatcctttatcagacggaagattctctttattgtacactttcactcctccgcgcagggatagaatgcatttgatggcatttgcacaaaacttatacataacgcacttcctttgttgtaatgatcaaaagtgttctctctctctattataacaatattttttattacctggtactaataattatatttttcctccgccgatctctatcttttatgacggattttgggtactatagagaaatggtgtttgatgaggtgaaaatgaatttaagccgtttgcatggaacgtgcaactttaaacctttcttatgcgtgtataacatagaggggagaaaaggcagtgacgatcgatgaaatttaccaaatgtatatgaatgatgtttaccggttcctgctctccatgacaaaagacaagcatctcgctgaagatttgctgcaggaaacctttatgagggcatacatacacattcactcctacgaccacagcaaagtaaagccatggctttttcaagtggcgagaaatgcgtttatagattatgtcagaaaacataaaaaggaagtgaccatttccgatgacttaattgggagcctttttcagacggctgttcaaagcccggctcatcagattgaaatcaaggaagtgctgacagggtatatgtccgaacttcccgacaattatcgggaggccttaacactgtattatttaaaagaactgaattacaaagaagcatcccatattatgaatatttcagaggctaattttaaaagtgttttatttcgtgccagacagcggctgaaagcactttataatagaggtgttaatgatgaatgaagaatttaaaaagcgtttttaccaatacaaaaatggagaaatgagcgaccgggaaatggccgcctttgaagaagagctggaaaagctggaagtctatcaggagttgattgaaagcgaaatgcaggacgaccgggaatgggacgtcggcatcagcccggaaaaacagaaggccattttatcatacggaaaacgcaaatcgtatttgcggatttcagttctcgccgtcatctccactttgatgattttgccgctttgcacattaggaagctacctctattacggtctgggaggaaaagaaagcaccggcaatcaattaatggagaccgcggcagtgacggtggcgaccacaatgccgaacgtcctcgtcgatacctccggactgaaaagccaggtgaagctgtttggaatgaatacggaatttccgctgcaaaagcagatcggcacaaaaacgaaatccgtcggcggagaacggattgaaatgtttttagatacggtcaaatcgcctgccgttaactactatgatttagacgcggcacaggcaaagcattatttcgcccatccttccggcttaaaggaacgcacgattgaaaaagccggacagacattaaaaaaattgcctgaaggaagcgtggcggaggtctatctttcttatgacagggcctacccttcttctcaagtatattcgacttttaaaaaatacgatgtgaagtttttatggaacgcggtcgaaacggagaaaaatctgaaagacagtccttatgccgagccgttaggatttcccgggaaagattccaagatggtgtcctctttcgaaacgcaaggacagacagaccgtgaacaatttatcaatgcccttgaatttatgtcccgccataaaaaatgggcgcatgcaatatcgaaacgcaaagacatgaatcttggcagccgaatcgactatgttgaacatcacggaatgaacgtatacggctctgtcgtgacggggccgacaaaagaaatcgaacgtctgctgaaaaacaaaacagtaaaagcagcaaacatcggtgaggtggaattatggaattggtaagaatttttaaagagcataatgttttcggctggatatcagtcggtaccgcgattttgtcgctgctgcttttgaacgtggcaatcatcagcaatgtgactttctattcttatcagatgctgccgtttgcgatggccgccgtgccgttcggcatcattgagctgtttattaaaaaaggacggacgggcccgggactgctcggtgtcattctcaatctgttcgtcattgtctgtgtatatacgatcgttgcggttgatacgaatctgcaattcggtttttaaacataaaaacaggcccttttacgggggcctgtttttttaaaatgaaagaacgccgattaaatgcagcaatacgacgatgatagccagcggcacgagatatttcagaaggaaataccacagctgaaagaaacgatagccgatggcggaaccgcttttcatctcggcaaacagctcctgcttcggtattttcagcgggacgaagattgatattaataaagcgccgagcggaatcagcacattgctgacggtgaaatccgcaagatcaaaaaacgtttttccgaacaaatgaacatcaccgagaacaccgtatgataaacaggacggaattccgactaagaaaatgagcagaccgcttgtccacgacagcttctttcttttcgtttcatcacctttcccgacagtcgccacgataatttccaccatcgaaaaggccgaagtcagcgcggcgaagaaaaagaccgccaaaaagctgataaaaaacagcgagccgaacggcagccggtcaaacacagccggcagcacggtaaacagcagtgtaggcccttcatccggtttaaagccgaacgaaaaaaccgccgggaaaatggccagtcccgcaaacagcgtaacgagcacattcatcataacaatggaacccgccgaacccggaagattttgggttttcggcaggtacgaactgtatgtcaccatgaccgaaacaccgagcgttaatgtaaaaaacgcctgtcctaaagcatataggatggattccggcgtcaaatcttcaaagtgcggaaccaataaaaatctaatcccctcaacggcatgatcgagcgtgactgatcgcagcacaagcaatagaaacagcacgaataaaatcggcatcagcaccgcactgacacgttcaatccctttctgcacgccttttgcgacgaccgccaccgtcatgatcataaatacaagctgcgcaatgagagtctggatcggattttcaatgaccgtcccgaacaccgtgccgtactgctcctgagtgagcccggataaagaaccggtaacggcttttaacacataaagcaaaatccacccgccgacaacactgtaaaaagacaaaactaaaaaacaggccgccacacccacataacccgtaaggtgccataccgacttcggcgcggcttgtttgtaggcatcaatcgcatttgtctggctccgtcttccgaaaataaattcaccgagcaaaagcggatagcctaaaagcacggtaaagaggacgaatataagaaaaaaagcgcctcccccgttcgtacccgctacgtaagggaacttccaaatggctcccaggccgatcgccgaaccggcagcggccataataaatcctatttttgaggcccattgaacccttttttggtcagacacgactttccacttcccttccgccctatattatcccttattcgctgcgataacttaagcccatttcaatatgtttcattattccgaaaaataaaaaggagcggcgggtgccgctccttacaaatccccgtttaatttcgaatgctttctcgaatataagaaataaatcaccagaccgatgatcagccagataaagaaacggaatatggtggtggcgccgaggttaataatcaaaaacacgcagaacagaatggacaatatcggaataaagggaacccccggacatttaaaagcccttggcagatcaggctgtttctttcttaatacgataactgccactgaaatcaggacaaatgcggcaagcgtgccgatgttcaccagcttcgccagttcatcaagcgggacgagcgagccgagtaatgccgacaggatgccgaacacccatgtcaccacgtgcggcgttttatgcttcggatggacttttgaaagcgcccccggcaccaaaccgtcacgggacatggcaaacattaccctcgtctggccgtacagcatgacgagcatcaccgttgtcatccccaacactgcgccgatatcaataatcccggccacccaattctgtccggccatctgcaggacgagagacacgggatggtcaacgccttcaaagcgggcaaacggaacgacgcccgtcataatcgccgatacggtcacatacagcacggtgcagacgattaatgaaaagataattcctttcggcagatccttcgccggatttttcgtttcttcagcggcggaagagacggcgtcaaaaccgataaaagagaagaaaacgagcgccgcggcactgaaaacaccgccgaaccccatcggtataaacggctgccagttgtgaggtttgacatatacggccgcaacggcgataaacaatagaacaaccagaaccttcaaaatgaccataatattattgacccgcttcgattccttaatgcctaaatagaggaggaatgtaatcgcaagcacgataacaaatgcggggagattaaagaatgtgaccgtgcctttaatagatcccggcgcggccgttaatgcagtcggaagatgaatgccgaagcccgccaagaatgattgaaaatagccggaccagccgaccgaaaccgcgctgacggcgagcatatattccaagattaaatcccatccgatgataaacgcgagaagttcacccagtgtcgcataagtaaacgtgtagacggaacctgaaaccgggacgcttgaagcaaattcggcatatgacagagccgcaaataaacacgcaagagcggcgatgacaaatgaaacggtcagccccggccccgccgtgacagcgcctgttccggttaatacaaaaattcccgttccgatgatggcccctatccccagaagggtcagatcaaaggcccctaactctcttttcagcgacttgtccccgcccgttgcggcaagcaggtcctgaatgcttttctttctgaatacgctccccttcatctgcttcactccttgtaaatcaatatatgttagaatattcagataacaatagcaataatgactaaattcttatttttcgcatgaaatgtttcagcacatcatccctttctcctatgtcatattatagcgaaaaatataaaaatgaaaataattttttgaaaattctatatattatttttagttttcataaaacagaacgcagcggattctccactgtgaaatattaacattagtgattcagctggagacttccattttttgaaaatcgtattcatatgtacgttcaaataaaaatcccgccctttttaaaagcgcgggataagacttgcgtattatgttgaaataaatctgccgccatttacgtgaatggtttgccccgtcatataggaagattcgtctgaagccagaagcacgtaagctccggcgtgttccgcaggctgtcccggtcttcccatcggagtgtccagaccatgcttttccaccttttcttcagtaaacgttgccggaatcagggcggtccagatcgggccaggggccaccgcatttactctgatcccctgatcggccaatgacatcgccattgaacgcgtaaaggaaacgatgccgcctttcgtgcacgaatagtcgatcaatgatgtgtctccctgataagcggtaatagacgttgtattaatgatggcgctccctctttgcaggtggggcagcacggcttttgtcatatgaaacatagaaaacatgtttgtacggaatgtcttctccagctgttcagctgtaatatcaagaatcccgttttgcggatgctgctcagccgcattattaacgagaatatctatttttccgtagtgatctaagacttgccggaccgccttctgacaatgcgcctcatcaccgacgtctcccggaattaacaggcattcggcctggtattcttccgcacgctttttcgttctctcggcatcggcatgttcgtctaggtacaggatggcaagatccgccccttccttcgcgtaagcgatcgcagccgctgcgccgatgccgctgtctccgcccgtgatgacggcgacttttccttttaatctgcccgacccttttacatccgggtcctccaagagcggtttcggctccatgtctgactcaatgccgggctggcgcttttgcacctgcggcttttgtccttccgtctgtctgtccatcggattcatattctcacactcctgcaattggtattactgagacgataccacgcagtgcggggagttaaacggacaaatatgccggtaattaaagctgctgagccgtttcgggaaaagcgccggtgtatttcgcagacggcctgtaaatcatgttgtcagcggactgttcaagcacgtgtgcgcaccagcctgccattctgcttgctgaaaaggtcggcgtaaacaaatcattgtcgacatcaatggcctgcatcacagccgctgcgtaaaactccacattcgtatacagcttccgtccgggcttatattgctctaacaggcggatggcttccttctccacataaagcgccaagtcaagcgacggatcatttcccgccacttcttcagcctttatgcgcagcgcttccgcccgcgggtcttttgttttgtacaccctgtgcccgaagcccatcaggcgttctcccctcataagcttcgctgccaaatacgcttctgcattttcttttgtcccgatgtcttcaagcattttcgtgacgcctgaaggcgcgcctccgtgcagcggccctttcatcgtacccagtgcggcagtgacggcagacactaagtccgattcagtcgaaacggtgactctcgctgaaaaagtcgatgcattcatcccgtgctccatcgccagaatcatatacgtctcaagcgctttcttttgggctgcggacggctgcctgcctgtcagcatatacaaatagttttcaacgtgtccgtatcgcgcctcaggtgacaacgcttcctgcccttgtttacggcggtatctgtacgcaataatcgtcggtgtgacggcaatcagtttaaccgcttcttccggcttgggcggatatgtaaatgaatctgtgcccaaacctgaaacagccgttctcagcaccgccatgtcgtccatttcatccggaagcgtttccagtaagtcgatcaaatgtttcggaagcccgcgctcggctgcaagttcttcctgaaacgcaagcaattgccgctcatcaggaagcgccccgttcaaaatgagatacgccgcttcttcaaaactgaattgcagcgcaatatccttcgcatcatagccgcgatatattaaatgccccttttctccgtcaatgtggctgatagccgtttctgcacaagtaatccctttcaatccacgataaatcaatttcattcccccttatcctctttctgttattatagtaaatataatatttaaaaaataatgaatatttttaagggaattaattaaaacttttaatcagaggagtgcatctatggattttaaatggcttcacaccttcgtcaccgcggcaaaatatgagaatttcagaaaaacggcggaaacgctttttttatctcagccgaccgtcaccgttcatataaaattattagagaaagaaatcagctgcaagctgtttcagcgaagcggccggaaaatacaattgacggaagaaggaaaagcatacgtgccgtttgccatgaggcttttggaagactatgaaaacagcatggcggaactgcacagggtgcgccagggctactcgcacacgctgacactcgctgtttcgccgcttatcgccgacaccgttctcccgtctgtcatgaagcgttatacagaggacaataaagaaaccgaaatgacggtcaccattttcgaatcggaagaaatcgcctctcaaatcagaaacggctcagccgatatcggactgagctgcttaaaggtgcaatcatcttccctcacttgccgccccctgtacaatgaccccgttgtcctcgtcgcgccgcccggccgaaaacccggaacagggaaggcggatgaagtgaaagacctgttcggacaatatctgcttttgacccacaaccatcctgactattgggatgatttgctccgccaggtcagaatacagttccctttcgtcaggacaatgaaggtgacacagacgcatattacgaaacgatttattaaagaggggctgggtgtctcatttctgccgctgtcagcggtacgggccgaactcgccgcaggcagcatgattgaaattccgtgcgaattcgcccagatgccgagcgcgggcgcatacgccatcgccctctatgaaaatgaaaaaaagaaaacctttttagattttttatcacattttcatttttaggtgaaacaaatggagctctgtcccgtctaaataaaaaacccgttctgatgaacgggtttctatcgctgctagaatcttttcgcgcccaggtagcgcggtttccagtagctgttattcagatcacttgttgtgacgccgtcagaaccggcatggatgaacttgttgtttccgatgtacacacccatgtgtgaagggccggcctgatatgttgtaaagaagacgaagtctcctcttgacgggctggacacgctcttcattgagctccagtatcccgcagtgctcgttctgccgacactcgtctgtttgtttaacaggtaccagataaatccgctgcagtcaaagccggaagtcgttgttccgccccatacatacggcgtgccgattaaagattgcgcatcagaaatcagcttgtttacattcaggctcgtctgtgcagcattatggctggatgaaggctgctttgatgacgaagatcctgaagacgttgaaccggaagttgatccctttactttaagaacttgtccgatgcggatcaggtccgtttttaaaccgtttaaactttttaattggtttaccgtcattttatatttattcgcaattttccaaaggctgtcgccttttacgactttatatgtagacgatgatgacttgctgcttgagcttgaacctgaggatgatttaccgttaatcgaaagcgtctgaccgatgtaaatgatatccgattttaatttgttctcagatttaatggaattaattgacgttccgtaccgatttgaaagtccccataatgtatcgcctttttttaccttaatcgtttgcgcagatgccgcgcccgcaaacaaagtcgtccccaaaaccactgccgttgttgctgtaacaagttgctttttcatattttcctccctgaatgattctatctattttatgtgtctcttttttaaagtttttatctgtttcctattataaggttcaatttccactagaaatagacttgacttcccgtgacaaatttcttactaattcgttttagaaaaaagtttttaagggtattaaatatttcaatttgatttcaaacgtgacgaaaaacgagtcaatttgtcatgtttttttcctgtgatcctcgtattttggaaaaacaaagcagtttattttccaaataaccccttgttaaaaaaatcctcgactttttcaaaaaagtgaatggttttcactctttcttgaaaacataactttacaccggaatttacatttctaacaatgtttcacctgaaatttacaggagaaacaggcgctctttacaaacaccccctaccattagacatgcagacacgattaaaggaggacgagtgagaatgagtctatttaaacaggttcgatcaaaacttctgccggcggcagccgtatccgtgctgacagccggtctgattgcgggcgcggggcttcagcactccgaacaggctgcggcaaaaaaacagcctgacaaaaacgaaatcagaaacgtcatcttcatggtcggcgacggaatgggcgctccctatatgaacgcctaccgttcggtcattaacaaaggaaagccttcggatggtatgaaactgacggcattcgatcccaatctcaccggtatgatgatgacttatcctgacgaccctgattccaatattaccgattccgcggcggcaggcacggcaatggccacgggtgtgaaaacgtataacgcggcgatcggagtcgataaaaaaggaaagcgggtaaaatccgtcctcgaagaagcgaaacaaagagggaaatccaccggacttgtcgcaacttcggagattgcccacgccacccctgcggcattcggagcccataataaatcccgaaagaacatggatgacatcgcaagcagctactttgatgaccgtatcaacggaaaacagaaagtcgatgtgctcctcggaggcggcaagtcaaactttatccgtaaagaccgcaatgtaacaaaggatttcaaaaaagcgggatacagctacgtgacatcaaaacaggagctcaaaaaggatcgtaacaagaagattctcggcctgtttgccgatggcggactcgacaaagcaatcgaccgctcaaacgccgtcccttcattagaagacatgacaacggcggcgatcgacaggctgaacaagaataaaaaagggtttttcttaatggtcgaaggcagccaaattgactgggcgggacatgacaatgatatagtcggcgcaatgagcgaaatgaaggattttgaaaaagcgtataaagcagcgatcgcatttgccaaaaaggacaaacatacgcttgtcgttgccacggctgatcataccaccggcggattgacgatcggcgcgaatgacgataaaaactggcatgttgaaccgattcttgccgcaaaaaaaaccccggcatttatggctgaccaaatcaaagcgggcaaatccgtatcttccgtgcttgcgcgctatacagacctgaaatggtcaaaagctgaaatcaaacagatcgaaacggccgcaaaacagaatgctgacaagagcatctacaaagcaatcattaagctctttaatgcgaaaaccaacagcggctggacaaccggcgatcatacaggcgaagaagttcccgtttacgcatacggtccgggaagagagtcatttacggggcttttaaacaacacggaccaggccaaaaagatttttcacatcctgagacacggaaaataaaaaaaggatgcgggggtttccccgcatcctttcttcttttacagatatctccggtgcactcctttgccgtcatacgaaaacatcacttctctgtcttcaagaacagattcgatgtgcacgctcctgccccacagctggtacagatacggcagcactttctccaaatatttcagatcaagctcaattccctcataccaatgtttaatataaagctcattattcttcaggtaatccccgtcattgacggtcagataaggaaatcccccgttgacccgcatgttcacgagctgatcgcgcacggccttccattctttgtcgatcactttatagtccctgccctgcttttggaataaatacaaatcctcacgcatcacgagatctttcgtcaaataattgcggataaatgatatatccgattcaatttccctgacctcaaacattttctcgcgtccggaaccgggctttacccctgtttttttcatttcatctgtcgggttgtcataacgctcttcgatgtcttcaaaaattttcagccctaaataatacgggttgattcccgtttttgacggctgaacgacgcctgcgttcagcttcgcaaattcgatggcttcatctgaagtcaggtcaagctcgcggataatccgctgatgccaataggatgcccagccttcgttcatgattttcgtttccagctgcggccagaaatacagcatttcttctctcatcatggttaaaatgtcacgctgccacggttcaagctcccgcgaatgttcttcgataaacagcagaatatctttttccggccggggcggaaacggttttttcccttttttctttttcacctgcttcggcttatccattccccataaatcatcgtaaggcgatggcgcggtttcttcttcgtcctcctcttcgtcatcgacgctccacagcagcttcggcctgacgagcgacggatcgatatgctcctgaaccgccagaatggcatctaaaaaggactccacctcttttatcccgtgaattctttcataatgcttaatccgctccgccgcagccgccatactctcaaccatgtcccggttcgtattttgaaagcggcagttatgtttgaaaaaatcacaatgggcaagaacatgggctacaattaatttattttggatcagcgaattgctgtccagcaaaaaagcgtagcaagggttggaattaatgacaagttcataaattttgctcaaaccgagatcataatggagtttcatcttgtgaaattgtttgccgaaactccaatggctgaatctcgtcggcatgccgtacgcgccgaatgtataaataatctcagccggacaaatttcatatctcatcgggtagaaatcaaggccgaaacccttcgcaatgtcggttatttcctcaattgcccgctgtaaaccttttgtctcctccgcgttcaaccgaatcccccctacttggacttatttataatgtatgacccctcctctcaaaagatgaaataacagaccggtttccgtctgaaaactttcggcacatccgccccgtttgctttatatgtaagtgggtaaaacacacaccatactccaaaaagaaaaggagcgattctacttgaatacagcagacatgcttacgacgtatctcagcaaactcccgaatctgatcatcgcactgctcgtcctgcttatcggctggggcattgccaaaatcattgaaaaagccgtatacaaaggcctgcaaaaaacaaaaatcgacgacaggctgttcgccgaaaaaaagccggcgcgctattcctcagaaaaagtcatcagtaaagtcatttattttatcgcattaatcatcgtttttattctattctttaacattctgcatctgacaaccgtggcttcgccttttgtcagcatgctgtcagcgataacggcggctgtgccgagcattttaaaagccggcctgattctgctgttgggctgggcagccgcttcgcttttcagctatctcgtcaaaaaagcgggcatgaaactcgctgaaaacggccggttcagaaaatggacaatggtgtctgaagaagcggagatgagcagatccgttacggccgcttcacgaatcgttttttacttcgtcttgctcttgttcctgcccggcgtcttggccgctctccaaatcagcggagtatcagggccgtttacaaatatgatccaaagcgttttgtcctttataccgaaattattcgccgcggcgctgattgttttaatcggctggcttgttgcccgtctcgtccgtgatatcgtcacaaactttctggcgagtatcggcacggaaaggctcgccgcacgtatggggctttctatatacctgaaggatacaagcctgtcggcaatcatcggaacgattgtctacgtgctgattttcattccggtgatcatttctgcgcttgaccggcttgatgtggcgggtatttctgaaccggcgtcagccatgctgcacacggtcttcacaatgctccctaatatcattatcggtatcgtgctgatcatcgccggcatctggatcggaaaatgggtcaacagcattgtatccgggctcttgcaccgggccggtttcgactctcttctcggtaaaatgggctttgaacagacgggtaccccgaagctgacgctttctcagacggtcggcatgattgttcagattatcatcgtcctgctgtttacggcagaggcgctgcagcttgttcatctcgaatttctcgtcgttatcgcaacaggtattatcgcttacctgcctaatgttctggccgctgtatttattctcggaatcggacttttggccggacagctcgtcagcagactgcttgccggtatgctgagcggaaaggaattcagattcctggcgccgcttgcgaaatataccattatcactctttcaatctttatggcgctggatcagctcggtgtcgccgacacgatcgtaaatgccgcgtttattctgattctgggcggtttcgcgcttgccttcggactttcattcggtcttggcggaaaagatttcgcctcccgttatctcgcaaaattggatcgcaaaattgaaaaacatcaatcggctgacgatcggaagccgccgatgtcttaacgaaaaaaacgtgcgctcagaaggagcgcacgttttttttttgagttaagggggcaaattccttttttttcattttagattcatatatgatagactgtaacagaagcaaaatctcttttttcgaggtcattctatgaaattaacgaactataccgattattctttacgcgttttgatttttttggcttccagacattccgacgaactttccaacataaaagaaatcgcagatacttattccatctctaaaaaccacctcatgaaagtcatttaccgcctcggccagctcgggtatgtcgaaacgatccggggccgaggaggcggaatccgtttaggaatgacaccggaagacataaacattggagaagtcgttcgaaatacagaagacgactttaacatcgtagaatgctttgactcccaaaaaaatctctgtatcatatctcccgcctgcaacttaaagaaccttctgaatgaagccctgcaagcttacctggccgttttagacaaatatacgttaagggatctggtcaaaaacaaagaggagattatgagactgctcagaagctgaaggaatgtccgcattccttcttttttttatgccggcataagaaaaaaggactatttctattaatatgataaacgattgcagacaagtgccgatataaagattatcattactgatatcctcaccttgcggctgcaacgaatggggatagtaaaatcatcgcaggaaaagggagattcattatgagaaaaaaggtagcggtcggtttgactgcatctgcgatcgtcgggtctgcgttagctgtaacaccggcagaagcacaaacgattaaggttaaaagcggagattcattatggaagcttgcccaaaactacaatacgagcgtggatgccattacatcagccaatcatctaaaatccaccgttctttctatcgggcagacgctcaacattcctaacggcaaatcagatgccggcagcaaaaatccatcttcaaagaacagcggcacgactaaaagcgtttatacagtgaaaagcggcgactcgctgtggctgatcgcatctgattttaaaatgtccgtacaggaactgaaaaaattgaacggtctgacaagcgacttaatccgcgcgggacagaagctgcaagtgacggggaaagtttcctcaagcaccgatcagaaaaaaaccacgccgggcagcagctcaaacagcagcaaaaagcagtcatcatcttccgggacgtataaagtcaaactcggcgattcactatggaagatcgcaaacagcgtcaatatgaccattgcggaactcaaagtattaaacaacttaaaaacggatacgatctacgtaaaccaagtcctgaaaacaaaaggaacgtcttcttcgggaaacacgccgtcaaaggacaattcaaaccaaaataaaaaccagacgcaaacgtcctcctatacagtaaaaagcggagactcactctggaaaatcgcaaacgcatacaatatgacggttcagcaaatcagaagcatcaacaaactgacgtcagacatgctgcgggtcggacaagtgcttaagctgaccaaaacgtcatcttccggctcttcgacttcaccgtcaactccgaaccagtccggaaatacagggaaaaccactacatataccgtgaaaagcggggattctttatgggtgatcgcccaaaagttcaatgtgaccgcccagcagatccgcgagaaaaacaatctgaaaacagatgttcttcaaatcggacaaaagctgacgattaccgggcagcagacaaacacgactccgaatcagtccggcaacacaggcggcacaggttcaacaagcgcgaagattaatgtaatgatcgatgccgcaaaagctcagctgggcgtaccgtatgtatggggcgggacgacgccgagaggctttgactgcagcggtttcatttattacgttctcaataaggtcacttctgtatccagactttcagccgcaggctactggaatacgatgacatcagtcagccagccggcggtcggtgactttgtctttttctcaacttataaagccggaccttcccacgtcggtatttatctcgggaacggccagtttattaatgccaacgattcgggtgtcgttatttccagcatgaacaattcctattggaaacagcgttacctcggcgcaaaacgtttcttctgatatctgacaagctgtacggcctcaataaggctgtgcagctttttttacagtctgaaaatattaatgctgatcacgtgttttgttacgggatggaaatacacttcagcacgggatgaaaacgtttcttttgctgtttgcaccgttacgcgaaacacatctttcgtctgttcccggttcacttttgtacggcccatgtacgaataatcggtaagctcggcccccttgtattcacgttcaagctggttccatgcgagctgctcccatttttcaactgacggatcaaggtgttctgtatgccctttttcagcgatcgaggcaatgagaatgccgcaaaacaagagggcaagcacaaatggaagggatttcatctttatgttctcctgagtcgttttttgtcaatcttagcgtgtccaaagaagagacggatatgcggttttattttatgtctccctcatattgctatgccgctgtgataaggccaccaacttttcccccgttgcatcgggcttcgacggcataaactaacggagaacttctcattgaaaggagaagcgttagatggatcatgccgattatgacaaagccttgtattacacacaccggtctcaatgggacaatttgttaatattgatggttcgtacaaaagatgatttattatcaaagcgtattgagcactttctgcacgcgtatcatttcgaatatgatcatgcggtgcttgaaaaagagctgtattctcttctcgggtatattgatcatgcgacagagctcgcttatgaagatcaattagccatgctgacataaaaacaatcccggcgtcagacgccgggatttcttatgtttgtgaacatattcagctcttcgatcatctctttcaggctgacagccatatcctcagatacggtccggcgctccatgtcgatgtgaatcgggtctaagaccagctgtttcgggatgacatttgcatagacgccccgcatgaccgtccgcatattcgccagcgcgttcatgcctccttttcctccgcccgccgcggccatgattgccaccggtttgtatgcccagtgatcgctgcttaaaaaatcaatggcgttttttaaagcgccgctcatgccgctgtgatactcgggagataataagacgacggccgccgactttttcacctgccgccttaactcttgcactgaaggcagctcgttctgttcttcttcaccgttataaagcggtagatcactttcgctcaaatcaataaaatcggtatgaaaccgatctcttatataagaagcggcaattctagtccgcccgttttttctcggtgtgccgctgatcactaatatgctcatgattttaccgcctttccaaaaacattatattttaccgcatacaatgccgcctgcgtccgatcggaaagattcagctttgacagcaggttggacacgtgggttttcactgttttttctgaaataaacagtgccgccgcaatttccttattgcttttccctttggctatttcttgaagaacatctttttcacgtggggtgagctgatcatatttttccttatcctgatcatcctgaaccatatgggtcagcacgtgaggcacaatatccgccgacagccggtaacgtccggaatacacttcccagagcgttttcactaaatcatcgggctgggcgtctttcagctgatacgcttttgcgccggctttaagggcgggaatgacatgctcctgatcagaatagctcgtcaaaacgacgatactgatgtccggaaatcgttcagccacaatttttgccgcttctatgccgtccatatcaggcattgataaatccatcagaatgatgtccggctccgtcttttcagcttgctgaagcgcttcagcaccggtggacgcctcaccgacaacttcaatgtcttcctgagtggcgaagaaatagcgcagtcctttgcggacaacgtgatgatcatcagcaatcacaattttcatcaatcagacctcctgtcccgaaacggaagccgaacggagacaatcgttccggcgccaagctcggattgcaatgtaaagcggcctccgattgcttcggcgcgcgctttcatgccggtcacgccgagcgacggcagccccgtatgcgtatctgcgctgaagcccgctccacggtcgctaatatgaagctccgcgcaatccgactttttaacggcggaaatgataacccggtccgttcccgcatgctttttacagttattcaaggcttcctgggcgatccgccaaagcgcgtgttcctgttcatccgtaagctccagctcatcctccatttcacaaacggcttccaggccgataagagcggcatagcttttgatcgacgcatacagccctttcgtcaaactttccggcttcagctgccaaataagcgccctcatttctgttagcgcatcctgagacagctcttgaataaacgtaatcatctgccggagccgatcatcatctgtaaagctctttgcggcttttgccgttaagctgacagaaaacagcatctgattgacggaatcatgcagctcttgcgcaagtctgcttcgttccatcaacagggcgttctgctgctcaaattcggccaatttcatccgctgaatcgccgttccgatttgaaatgcaaccgcttcaagcagatgcagttcttcttcgttgaaaaatgtcttttcgcttgcggcgacgtttaataaaccgaacttccggccgccgtcctcaagcggtacggtcgcatgatgggtaatgccctccgtatcgcggcagttcgtcgtctgttccgcaaattcaatccgtttacaattcattatgtttacggcctttgtcaatccgccattgctgaatttggtcagacaatagcattccccgctgcacatgagtgcattttcccgctgaccgagagccggcggtaaataagcggatgcggcgagcgtataagatccgtccggctcaatcagaaaaatccaccctgtctgcagcccggtcaggctgagcagttcgcgaagcactttatcaagcgcttcctttaaatcgtggctttggtttaaggtttccgcaatcgcttttaacgtttttaacgtttctaccgtcgttttcgtcaatttccctcactccggccaatcagaattatccatattatatcaattcttttctgtatattcctttgttttcagcatgaattttcctcatactttcggatgaggcgtataaaaaaaccgccggatgtcgcttccggcggtttgttgtttatttcgttttttccactatgccatccaccgttttcatgacagcttcagataatgcggcaagacgctgttcgctgtcttgtaaagaagttcccttcacggcgaaatagaacttcactttcggctccgttccggatggacgaaggcagaaccaagagccgtcttcaaggaaatatttcaggacatttgacttcggcagatcaatatcttcttcatgatgatcggcaaatacagtccgttttcccgttgaatagtcttcagcctgcgtgatttgttttccggccatctgcttcggcggatcgtttcggaaggaagtcaggatagcggaaatctgctctgctccctgttttccttttaacgtcaatgacttcaagccttcacggtaataaccgtattctttaaaaatggacagcagcgcgtcataaagcgacatgccctgctttttataaaaggcgcatacctcgacggctaacagcgcagcctggatcgcgtctttgtcacgcgcgaaatcgccgattaagtagccgtagctttcttcatacccgaactggaacgtgtattggcctgatttttcatattctttgatcttttcaccgataaatttgaagcctgtcagtgtgtcaaccgtatctaatccgaacgatgaagcgacggcgcggcccaattcgctcgtgacaatcgttttcatgacgacaccgttttcaggaagggcgccctgttttttcttctcggaaagcaggtaatgcaataaaagcgcgcctgtctggtttcccgtcagcactgtgtacttgccttcgctgttttttaccgcaatgccgagacggtcggcatccgggtccgtagcgacgagaatatcagcgttttgttcttctccgagtttaatggcatattcgaatgccgcgtgctcttccggattcggcgatttgacggttgaaaaatccgggtccggcagctcttgctccttcacgacggtgacgtttttgtaaccgagtgcttcaagaccgcggcgcaccggtttatttgccgtgccgtgcagcggagtgaacacgacgctgacatccacttcatccgaaagctcgggatgtacggagatggaagtcagttcttcagtatatggtttatcaatttcttcaccgattattttaatcaaacctttttctttcagcgactgttcatcttcaacttgaatcgttaattcattttctatggcattcacttccgcaatgacgatgtccgcttctttcggcggcagctgtgcgccgtcatcgccatacactttatatccgttatattcaggcgggttatggctggccgtcacgacgataccggcataagcgttcagctttctcaccgcaaaagacagctcaggcgtcgggcggagctcatcaaatacgtatgtttgaatgccttgggaagcaagggtttttgcagcctccatcgcaaactcaggagatttatgacgggagtcgtatgcgatcgcaacccctctttttttcgcgtcttccccctgtttcgcgatatacgccgcaagtccggcggatgctttgcggaccgtgtaaatattcatcctgttcgtacccggcccgatttctcctctcatgcctcctgttccgaactcaagatttttgtagaaaaaatcttccagcagctgctcgtttccttctgcgtccgccaataattttttcaattctgaatctaattgttcggcctgattccagcgttcgtaactcttactccaactcatgttcgtcctcctataatttcagcttatgaccatattttaatatgaagcggctgcccgtgtcacttgataacttaaccaaatgctttatgtaaaaagataaaagaagggctcatgccttttcggcacagccctccggttattattgttcgagcggaacaaccgcgtcgtgcagcagcgtatttaaccactcagtgtgtttttctttcgtttcgtcattccattggaatcggtcgctcatgtaatcaatcacggctgttttatacgtttgcacccatttgatgtcgaagaacagtcttcccgttctgcggacgaagaaatcggcaggtgtcgcagccatttcttcttcgatgctgtaagccgcttccgccagaatgtgaaccggaatctggcgtttttccgcttcgtctttcagaccttcaatccggctgaatacattttcaacgttagagccgtatctgatggctaactgcttagcggtttcctgtgataaaccgattttcaagccgtcttttgtctttgcttccacaaatgactcgaagtttttagagccgccgacatgtccgccggaaatcggcatcgtcttcgtcttgcagccgccgaagtcctggccgccctcttctttcaagcggtcgcggacaagatcgacaatgtgctcagccattttacggtagcccgtcagttttcctccggcgatcgtaatcaggcctgattgagatgtccagatttcatctttacgggagatctcagacgggtctttcccttcttcgtgaataagcggtctgaggccggcccagcttgattcaatatcgtccgccgtaatgttcagttccgggaacatataattgatggagctgacgacataatcgcgatcctgcaccgtcatccgcgggtgctcaagtttttgtttgtaaaccgtatcggtcgtacccacgtatgtttttccttcacgcggaatggcgaacaccatccggccgtccggcgtatcaaagtacaccgcctgtttaagcgggaatacggattggtcgaatacgagatggaccccttttgtgtgctgaagatgttttccgcttttgctgtggtctttttctctcagctcgtcgacccacggacctgtcgcattgacgatttttttggcgtaaactttgtattccttgcctgacagcagatcttcaattaaaacgccgacaacttttcctttttcataaagcagttctttcactttagaatagttgacaggctccgcaccgaatttaacggcttctttcatgacttcaatcgtcagtctcgcatcgtccgtccggtactctacataatagcctccgccttttaagccgtcttttttgacgagcggctctttttgcagcgtttctttagcagacagcatgcttctgcgctctgatttttttactcccgctaaatagtcatacacacgcaggccgatggaagtagagaatgaaccgaacgtgccgcctttatgaaacggcagcagcatccattccggcgtcgtgacgtgcgggccgttttcgtacacgatggcacgttccttaccgacttctgcaaccattttgacttcaaattgcttcagataacgcaaaccgccgtggacaagctttgtggatcggcttgatgtgccggccgcaaaatcctgcatttcgctcaaagcgactttcattccccttgaagcagcgtcaagcgccgtaccggcacccgtaatacctccgcctataataaacagatcgtatgtttttttagtcatgtcttccagcatatgatcccgttccaaacttgaaaattggtgattcatcattacgtttcctccttgttgtcacggtatagaaaaagagaccacaacagccaaagcgcatgtcatcactttggtgctgtggtctctcctcatctcaggaccgttcctattaacttgttttcagtataccacatttttatcttatttaaaagccatagctgcatttactgcttttttccatccgccgtacaattcatcgcgtttttcatcttccatttccggtttgaattgcttatcaaggttccattgatcagcgatttcagtgctgtccttccagtagccgacagcgattccggccaaatacgcagcaccgagcgccgtcgtttcattaatttccggacgttcgaccggcacatcaagcaagtcgctttggaactgcatgaggaagttattttttaccgctccgccgtctacacgcaatgtttttaaagagatgcctgaatcagcctccatggcatcaagcacatctttcgcctgataagcgagagattcaagcgtagcccggataaaatgctccttcgtcgttccgcgtgtcaggccgaaaactgagccgcgcacgtcactgtcccagtacggtgtgcctaatccgacgaaagcgggcacgacataaacaccgtcagcggaatccacacgctctgcgtatgtctcgctttcttttgaatcttggaacatccgcatgccgtctctcagccattggatggcagaacctgcgacaaagatgcttccttccagtgcatactcgacttttccgtctaatccccaggcgattgtcgtcagaaggccgtgatcagaagtgatggctttttctccggtattcatcagcataaagcagcctgtgccgtatgtgtttttccccatgccttcttcaaagcacgcctgaccgaacagcgcagactgctggtctccggccgctcccgcaatcggaatgtttttaccgaagaaatgataatcaaccgttttcgcgtacacatgagaagacggtttcacttccggcagcattgatttcggcacgcctaaaatatcaagcagctcgtcatcccattttaattcatgtatattaaacatcagcgttcttgaagcgttggaataatccgttacgtgcgccgcccctccggacattttccagatgagccatgaatcaatcgttccgaacagaagacttccgttttccgctttttcccgcgcgccttctacattgtcaagaatccatttgactttcgttcctgagaaataagggtcaatcaaaagtcccgttttttctctgaatgtatcattatatcctttttcacgaagctcttcgcaaatgccggatgtttgtctcgattgccacacaatcgcattgtataccggctttccggtatctttatcccatacgaccgtcgtttccctttggttcgtgatgccgatgccggcaatttgatcagcgctgattccggactcggagatcacagtcgcgataacggcgagcaccgatccccagatttcgttcgcattgtgctccacccagcccggctgagggaaatgctgtgtgaattccttttgagcggaatgcacgatttttccttctttattaaaaagaatcgctcttgaacttgttgtgccttggtcaattgataaaatataggtctccatgatgccgctctcctttttaaatatattcagaatttgataatgttttccgtgattgagatttcttggtataaagataaagtatgaaaagcacgataaccattataacgcttacaaaccaaaagctaggtgtcacatttcctttaaacgcggcattgtaaaatacgccgccgaacgcaccgcccatgatcggaccgactacgggaatccaggcatatttccaatttgacggcccttttttcggaatcggcaaaaaggcgtgagcgattctcggccccaaatcccgcgcagggttgatcgcatatccggtcgtccctccaagagaaatcccgatggcaacgatgaggaatccgacaatcagcgggttcagcccttttgtaaattcattcgctccgattgccaaaatgccgagcacaagcacaaacgtaccaatgacttcacttatcatattcccaaatgtatgaggaatactcgggccggtcgagaaaacgcccagtttagcggccggatcatccgtcgccttccaatgcggcagataatgaaggtacacaacaaccgcaccgatcattgctccgatcatctgtcctgcaatataaacagggacctctttccaaggaaagctgccttcaagcgcaaggcctatcgttaaagccggattcaagtgggcgccgctgatgctgccgacggcatatgccgccatggctactcccaatccccagccgaatacaataacaatccatccggattggtatgaaagcgatttctttaaattgactcccgcacaaacgccgccgccgaaaataacaagcagcattgtaccgattacttctccccaaaatgctgtcatcatcattcctcctaaatgacataatagcaggtttgacagagttatagagaataaaaaacccacaacaaaccgctttacgctttattgcttccgtaaagagctgttgtgggtctccgggtctccatcacatagtattaacctaggtctattgtaacaatgggtgtaagcggtgtcaatctttttttgtcatagaatgttcatatttagcccataggtcggtgtctgaagtcgtcacggccgtggctcctgcctgcaaggcgttttcaacgtcctgctccgtgcggatgaagccgccggcaaaaatcggaatccccgtcatttctttaatttctctgattaaagtcggaacgatgcccgggagaacctcgataaagtcaggcttatgctttccgacgaattccatgcttttctccatggcgctcgtatccaagagaaacagacgctggatcgcgtatattttcttttgtttcgctttgacgatgactgatgatctcgtcgaaatgatgcccgcgggccggatatcctggcaaatgaactccgcaccgtattcatcatgcttaatgccgtggattaaatcgacgtgaaccatcagaagttttccgtgttttttcgcttcattcacgacaccttttaattgaccgaggtggatatctaaaatgacgccgtataagaacggactttctaaaaatgcatcgaattgcttcatgttccggattgccggtagaatctgctggttgtgaaaactcatgttttactcctttacattaaaaatcaatgctcagcacgctttccttgacggtcgaaatgatgaaagagagctcctcgtccgacaggcaaaaaggcggagacagctgaatgacattattatatcccgctacagtatcgccatttttcccgacaagcaggcctttttctctgcacgcggtgatgacgtgctgcacaagggcggcatcagcgggttccttcgtgattttgtccttgacgagctcaatgccggcaagaaggcccttgccccgtacatctccgaccgccggatgttctctgagcggctcaagctcacggagcagcctttctccaagctcccgggagcgggcgatcagattttcgtcctccatcaattgcaggtttttcaaggccagggcgcaggctgccggattgcctccgaatgtattcacgtgccggaagcggccgtacggctcaccgcccgaatacgcctcaaaaatctcccgttttactgccgttgccgacagcggcagataagcgctcgtaatgccttttgccattgtgacgatgtccggtgaaacgccgtaatgctgaaatccgaacggctctcccgtgcggccgaaaccgcaaataacttcatcactgatcagaagcgcgccgtggcggcggcaaatgtcctctacctttgccatatacccgtccgggggcatcagtatccctccgcctgtaataatcggttccataataacgccggcaatcgtttcgcttaactcccacgtcatgatccggtcgatttcatgcgcgctttccaatgtgacggcatcgccgggattccgatagagatcaggcggcgccgcgtgcaaaaaaccttgtgagagcggctcatatttatattttctctgcgcctggccggtagcggcgagcgcccccatcgtattgccgtgatagcctctgtaccgggagatgaatttgaagcggctgtgatcgccgttttcaatgtggtattggcgggcaattttgaacgcggtttcatttgcttccgatccgctgttggaaaagaagattacataatcgccgccgagccattcattcaatttttccgcaagctcaatcgcgggttgatggctttgggtcagcggataataaggaagctccttcaattggctgtaagccgcatcggcaagttcctttctgccgtatccgatattgacgcaccacaggcctgacatgccgtccaaataccgtctgccgtcaatgtccgtaacccaggcgccttcccctttttggacgattatgctgtcatccggctccgcccctttcatcgcgtgccaaatcagctctttatccttttgtttgagtgactgatttttttgtacatgttccacaccgctcatctccctttcaatatcattgcactgtatcgaaagctgcccggcttctgacgccgattctcttggtgaagttttcctcttaataagaatataaaggcgcggcatgggcgagtcaataaagcggcggcaattaaaaaaacgctttctcccagaaagcgaaagggctacaagagcatatcccgaaaccggggccggtgcaagtgtttttataaaaaaacccgccccttagggactgccccccgtttttgagacaggggtcaaaacaccttttaaacagccaattgccgatagtttatcggtgattggttgtttagtttggtttgaatacgaatattgttataataatgaatgtattctatgacagtgcgttctacgatggcagtcgtagttcgatcaatgctgttaagatagaacgtttcagactttagcgaggaatgaaacgattcgatggaggcattatcagcgggcgtccctttgcgggacatgctcatggtaatgccttttgttttaacagctttttgatactcgtaagatgtatacacagaaccttggtcactatgtaacacgcagttctcaggcagcattggtagctgatcaagtgtgtctaagacaaaggctgtgtcctgcttatccccaatagtaaaagcaatcacttctccattgtataaatctaatatactggaaaggtacaattgtttctgtccataaggcaaatatgtgatgtccgttactagtttttcaagaggacgatcagactgaaagttccgatccaatatattatcgaccacggcatatggctgcccatccttcttgcgctttttcaccttaacccgacactgccattgatttttctgcataatacgttgaaccgttttatggttaatacacattctcttttttagtatggctgtgatttttcgatatccatatcgatacttgtgctctcggcacaacgtgccgatttgtttttccaaatggcgcttgggatgatccttcatcagattcttcttccaacgataataagacgctcgagagatacctaaatgaatacagatatcctgtacggtcattgtgctgtgcaatatttctacaagttcgactgacgtttcgctatcaacttcctttccaattcgttgtacttttttaaaacttcattctgttgtctcaggtaacgaatctctgcctgcagtttctctaaatcggaagaatactccggaccttttccgtaagtgtattgctttccaacaggctgttcgaatcgatgtgtatcaccagccttataccatctaacccatgtctgaacctgtgtcttattcttaatattcaactcctgcaggatctctttcataggtacgcctgccaatctcatttctacagccttctgtttcacttcaaccggataactcactcttgtccccatagaaaaaacacctccaagtctaatttcggataacaatcatccgtattcaaacttgaaggtgtttttatttgtctcatcttatggggtcagtccccttaagcggagcgggcgttttttttatttcagatgcgtaatccggtaaatgtctttgcgccggtctttcagctggcgcacggttccgttttcacgctgccttcttaagatttcaaggtccacgtccccgatcacgaccatttcgatattcggattcgtttcaccgacgattccgtctctggcaaattcaaaatcagacggagcaaaaatggctgactgcgcgtattgaatatccatattttctgtttgcggcaggtttccgaccgtacctgagatgacggtgtaaatttggttttcaaccgctcgcgcctgagagcagtaccttacgcgcaagtagccttggcggtcttcagtgcagaacggcgtaaagataattttcgccccttgatccgcggcaattctcgcaagctccggaaattcgatatcgtaacagatctgaatggcgatctttccgcagtccgtatcaaatacgcgcaccctgtctccggcgctgatgccccaccatttccgctcattcggcgtaatgtgaagcttatattgtttttcaatcgtgccgtcacgtctgaataagtacgcgatgttataaattttcccctcttcttcaacgaagtgggagccgccgatgatgttgacgttatatttcaccgcgagatctgtaaagaggctgatatagtcctcggtatattcggtaatcctctgaatggccagactcggagaacgctcctcgaggaaagacatgagctgcgtcgtgaaaatctccgggaacactgcgaaatcagatctcgcatcggaagccacatcgacataatattcaacctgattggcaaattcctcgaaggagtaaatctttttcatttcatattgaatgacgcagatgcgcaccggaaatgccgatttgtaatagcgcttcgattgcggcaggtaatcgacattgttccattgcattaatgtcgcatatttaatggacgcggtgtcatccgggagataattcggattgatccgcatgagcgtaaatccgttcatcagctggaaagaaagcaccggatcataaatctgatggcgcgtcacctgttcgacataagctctcgccgtcatttcttccgcatacttatgataattcggaatccgcccgccgataatgatgcttttcagattcaatcgtctcgccaagtcttttctcgcctcatacagccggtgtccgattttcatccgtctgtattccgggtgaaccattacctcaatcccgtacagattcaatccgtccgggttgtggttcgtgatataaccgtcgtctgtaatgtcctgccacgtgtggcggtcatcatattcatcgaaattgatgatcaggcttgagcatgaaccgataatttccccttcatactcggcgcaaaactgaccttccggaaagtgcgcgagatggctgattaaatgctcaggctcccacggctccatccccggaaaacaatccttttgcagctcaataattttgttgatatctttctcttccatattccggatgaccattttcttttcaaaacgggtcagatcaagtttctcagacaatgctgcttccccctgccgtttcgttttgatcgttcaatcgctgtaagagtaattcaagttccatttccgccatcgattccagtctgtgatcgtattcttcaaataacagggcgcttgttaccttattcgggacgatgacacatttcatgccggcccgtttggctgcgattgagccgttgaccgaatcctcaaaggccagacattcagatggttcaacgcctaaatgttccgcagctttcagatagagctccggattcggcttcacttcttctacgtcgtcagccgtctgaatcacttcaaattcatcaaacaggcctaattccttcagatggcccgatacccatttaaaatctgagctggacgcgagccccactttcaatcctaattcttttgccgcggctaaataagcctccaccccgggacgcgccgtttccgtcttcatccgctgttcgaagcgcccgcgcctgatcgccgtcagttcatcatgatcgagctttcttcccagctgctcctctaaatatgcgaacggcttaaaccccgcggccgttccgatcacctttccccagacggataaaggcaatgttgaaccgtgttcttcaaacatttcctgcagcacttcatattcatgggtttctgtatctaaaattaacccgtcaaaatcaaagattaatgcttttatcaatggttacagctcctttagctaaacgtactgacctatgtatacactataccgtgaatttctttcgcgttcaaaatgtaacattctcacggaaagaagagcctgcatgagtgcaagctctcttcatccgttactgtgtgttttgactggaaatattggaaagagctgctcccgcagactcatttgaacgctgatcgaccgctaagtctccaagcgcaacgatcccgaccagatgattttgatcgacaatgggaaggcggcggatttggtgttgggccatcagatgtgacgcctcttcaagactcatttccgggtttccggatacaactgcagaagacatcacgtgtgaaacaggtgtttggccgtcgcggccttgagccgttgttctcaatgcgatatcacggtctgtcagcattccttttaattcccctccgtcaacgacgggaattgctccgacattatgctggtgcatcagcgcagccgcttcctgaatcgtttgattgggagaaacggtagccacgtgggtagtcattgattgtttgattgaactcattgtaaagcacccctttcgacatttattatgctcggggatttgtctcattataaagggagttagaggaaagaaattgtggtatcatgtcaaggaagcaaaaaagagcctgttaaaaggctctttatacccgtcagatcagccttctgtgaccgcaggcatctgatccggcccctgtctcgaaatcatcataggtaaagggaaaattcattccgcattcattcagcaaagcgcaatttttatcaaacagcgcccgctctttgacgtcatataccgggtgcggctttgacagcatgatatgtaccgtttgcagacaagccataatttgaaacgcttcttttaaagttccttggtaacgttggttttgtaatgataatacgcccctttttttaaagcgctgaatttccagttcggagaaataaagaggaaagacattttgaaacaattcagaggaaagctcttgtatcgcgctttcttgtccgtcagtcgctgcgttcacaattctcacatcaatcacctttcttgccatgtgaatatccttaatctttatcaagaatagcatagaaaaaaacgcgaaagctaaggtaagtgtttcctattgaaacagccgctttccgcttgaaaaggagctttatgatatgaaacaaaatgaccgcggtctggaactcctgattacggaaaagcacgccggacaatggctgttttcagtcctgaaatctgaattccaggcgtcaaaacccgtaattacggaatggatgaaccaagaaagcattcaggtgaatcgaacatccccgaaaaacaacatcatactgaaaaacggagatcgcttattcattgatcttcaggaaaaaacgggttcttcggtgactccggaatacggagagccggacattttatttgaggacaatcatatgctgattgcaaataagccggcgggaatgccgactcatccaaatgaagagggtcagaccggcaccctcagcaacctgatcgcttaccattttcaaatcaacggcgagcaggcgaaagtgcgccacgttcaccgtcttgaccgtgacacgtcaggcgcggtcgttttcgcgaaacaccgcctggcccatgcactccttgaccgtcagctcgaaaccaaaacattaaaacgcacctatatcgccgcggcggaaggaaaagtcacgccgaaaaaaggcacggttgactcgccgatcggccgcgacaggtcacattccgtcagacggcgcgtctcatccggcggacaagccgccgtcacccattacaaagtgaaaggctatcatcccggtgcgcagcttacattggcagagcttgaactggaaaccgggagaacacatcaaatcagggtgcatatggcaagcatcggccatccgttggcgggcgatgacctgtacggcggaagcaggacgctgtttcacaggcaggcgcttcacgcaaaaaaagtcagtgtcgtccatccgatctcaggagaagaaatcgttgccgaggcgccgatgccggctgatctggctcattttaccgaaacgtatttttcttaaacagggtcggcatatataatatatcgtttcggcgcatttccaatgtaagaaaacggatagcaagtggtcaggatcagttcctcccgcttgtgctgaagggtgatgacagatgtatcatcccggctgacgatttttgtacggctgattttataagaaaacgtgccgtaagacaaaatcacgttcagtctgtctccttttttcagttcgccggtccggcggaacaccgtgtccctgtggccggataacacaatttggccgtgatcgcccggataatagctgtccttataatgtccgacgccttttgctaaatcatctgcgtcagtcccttccacgatcgggagctcagcgtcgatttcagggatttctaaaatgccgcttgcctcacccgtttcggggtgaaattcttttttgcgctgtgtcagcacagcgctttttgtttcgttcttttccaagacaggttctgttgctttttttgcttcttcaagcgaatggttcgttttcatatgtgaatcaatgatcttccagcttccgtaacatgtgatgatgataccggcgatgatgacgaaaagcggaataagtttcagtttgttcatcgtgtgcgggttccccttttctttctgaaaagccaatatacgccggcacccgtgatcaccagaccggccaatgccgtctgatggctgcccgctgaagtatcaggcaatgggcggcctttttgtgtgccgctttcagtctgttttgtgctttgttccgaatttgcggcagacgccggacgggattcgggaattgactccactgtatcagatgctgtttcttttacgacaggacgttcaggttttttggtttgatcaggctgttctgctgcatccggtttttccgcttgaggtttttctcctttatcaggcctggtaccgcccggtgtttccccgcttcccggctgattgccggtgtcatcaggtgtttcggcggctgatgccgtgcggatgcggccgtcggtttgataagaaatcggtgcggaaaagcttttgacatagtctactgtcgcttccaaatcctcaggccccgtcaccggattcttgccgagtttcccgatcggaccgtattttgcccccgctgccgttgccataaattgattgactgttactgtatatcctttttcgggctgtatgtctgtcccgtccgccatcttcatatcaaccgcttgtccggtttccgggttccatgtataggaaaatccgctgatgctgtaatccggaccgtacaccggagaaatttgcgcgttaatgatctcccgcaaatcttttcctttgatttcaagcttcgtcagcacattgccgaacggctgtacattataaaggtctccccatgtaatcggccctttttttatgccgtcccggatgcctcccccattcataagcgcaaaatcggatttcatcttctctttcataccgtcggcaatcagatttccgagcgccgtgtcgccgtcatttgaatacccgcccgttatatcatgagccgcttccccgaccgcttcgctgataatcggtttcactttctcttcatatttgcttaatatgcctgccgcagccgggtcaggcttgattttactttgatcgatatattggatttccgctgattttttcacgatatccttcgactctttatcaagttcaagatcggcgattccgattgcttttccgtattcaaatgcctgcacgatcagcttgccgtcgatttctccgtttacgactttatgattgtgcgcggcgaaaatcacatcaatctctgagtctgttccgcttgcaagctttgcggattctcccgtgatggctgagccattttgttcagcagacatatgggcgagcacggcgattgctttaattccttttttcttcaggtcagcggcggcgtcattgacggcctttacctcatccgtaaacgtaatatttttaattccgtccgggatgaccatgcctgccgccgatctggttacaaccccgataaatgcgaccggaattccggaaacgtatttaatttcatacggcggcagaaaggactcccctgacttcagtttacagttggcgcagacgagcgggaaattttggccgtcataaccgcttgtccccttaccgtccggatgatctcctccattgatgatccgtttaagctcattcgttccttcatcgaattcgtgattgccgacagttccgacatcaaaaccgatgtcttccatcaattctactgtcggttcatcctgaaaaagggctgacacgggagagctgcccccgatcatatcgcccgcatgcacgacaaaggcgtgttctttctcggctttcgcctttttaatgtacgctgcggcgtagtccatccgcccgaaagtgccatccggtttaccgtctccgttaaggtcaagctcatattgctgatcaatttttccgtgcagatcattcatactgatgattctgagcgggacacggccggagtcttctgtctgctgttctttatacgctttatccattccagcttcattcagtgatcctgcttgtccgattgcttccgcatctttcacgctgaacatcataaaacaaaccgtcagcaaacagcacgtaagacgcatacccctttttttcttcatttatttcccccctgtcttctaagaaatacgttagcttattttcttaaaaatcacatcacttttttgtaaagattgtcttcactggcgcaaaatagtaaataatccccacgtaacgaaacaggtcttgatgtataacggatcggcttttttcacatcttaatgatgatttgacatgaaggaggaaaacaaccaatggaacagcagcagaatcagcagcagccagtaaatcaggggatcccgggttcaccgcaagtgaatcacggaggacatgagcttttcgatatgcatgaagtgctggccggaacagtcggcgttttggatcaatttatgatgctcagacagtttatacaggatcagcagctggccgacatccttgaccgccagtatcaattcattctcggactctataatctgacggcagaatgctttaagaccggccaaaagccttctcaggaaacgtcgacatatatgatgaaggaacagaaccaggccgtctacggtataaaaccgactcagccgaaaaaaccgaatcaatcattaaatgatgtcaaagatctcgggatcagcggccatatgctcggcctgattaaagctcaagcttctctcttgacgatgagctcgcttgaaatgaccaatcccgtcactagaagagtgctctccgcccaaattcagcaatatgtcgaaatggcgtatgaaatcttcttataccaaaacaaacacggttattatcaggttcctcagctcaatgcacaagatatgcagaccatgctgaattcatttgcaccggcccagggacagccgcaaatgcctccgattaaaggacaaatgggacagcagcagcaaaacctccattgattaaaaaacggcgttggaaacctgactctccaacgccgttttctttttttcatatgcttttgtgaaatcatgttcaaatcgtttcaggctttctttcgtagccgcttcaaagcctttttcaaaatcctgtgtttcggcggttttattgataatggttaagataatgccttctccgaatgtgtcggttaagtcctttatcatatagaagctttgcaaatagacatccgtttcatattccatacgcgatttctgccattttcggtcggtcgttaattgatcaaacggcacgacggaaaatgcaatcggatcaatgactacatcataatgcgcgacccactcgctcagcccctcatgaaaccaaagcggaaatacagacgtatccgtccccaattgccgcgttttttgatgaaacgcgtagtgtgtatattcatgtataatcaattgcttatacatgaaaacggccagctcatcttttttcaaaagcttttttttctcttcaggcaaaagccccatcatctgctcctgttctgaataaaaaccgactacatttttcaatcctgaatattgctccatttcagcttcatccgaaaagaaaatgagttcaagcggcgctgcacctttatagccgacaatgatttgattgatacgctttgcgtggtccagcgtaagcttggtcagatccaagagcggcttttcatccgccgtatagtaaatcgctgtatgtttgtaaatttctttattcatgtgttcagtcacttgttccttcgtcggaacagagcggctgttttggcctgacaggacgtacatcatacttactgaaacggctgaactgacagccaatatgacaaggactccgcacaggatcagagtgaatgccgcccgtttccccatgccgtcacgcaaacaagctcccctccccgatcctttcattttcatctcattctttactttatgctcaggagcgctgggtcgtgacggcagataaaataaaaaagccgcagcaaatgcggcttttccattcatttatttattggggtttgggaatacacgctgcaccatttggccgaattcatcaaacagaccggatacaggatgtccgttttggattcgttttccgtagccttgcatgcgttcaacgaagtccgggttcgctgatacatatacagtccggacatgtttatcggctgatttcaccttatcggtaatcttattttttaaatggttggcgatggcgcctttttgcccgtttgtcaaaacaacggcaacatatgcgctgtttccggcaacgatcacagtcgcatttttaacctcttttaaatcagtcaccttgtcggcggctttatcagccactctcaggttacgattgtcattgtgatcgttgttttggttatgacggttcactgtattcatatttgtcgcaccgtcgttaggcgtgttgcggtaatttacattctgggtgcggttgtcatttcgttttccttctccttggttccccatactgcaccctgcggtaatcagcatcggcagaagaagggcagagataactgcttgtttttttatcatgtgaattcctcctttctcactttacgtataggtttttctattcggcgggatttatgcacgccgtttgcattctgagcggtttggataaatatcagaaggaaagggaaaggtaagcgtaatcaattgaatgaggagggatttaacttgttcagaaaaaaaagcggcatcagcccgacagcgctgctgatcggatcatcgattctgattgcagctttatcacccgaaatccgccggaaaatctccggaatggtttcaggcagaatgcagcataaagatggcacacactccatgcagcctgttgacctgattcaacaggcgttcggcggggaatccggcggacagcagcacgcagacaaagcccggcattcacaaaccggctcattgcagcctgccgagctgatcaaacaagctttcggcggggaatccggcggacagcagcacacggacaaagcccggcattcacaaaccggctcattgcagcctgccgagctgatcaaacaggcgttcggcggggaatccggcggacagcagcatgagcagacttcccgcaatcacgccggctcatcccatacggacggacaggcagaccgcagccgcagtaaagaaacttcgccgaagcctcactataccgagccgattcactttgaagaaagcgcggtaaatgttttaaatgacagcaccgtgatgaatatgctggaagaaattgaacccggaaatcattagaaacgaaaaaatccttcattcgttcaacgatgaaggatttttcgttttagcgctttatctcatatttttctataagagaatgaaccatcgatctgcttttttgttaagcttcttcagcttcaatgacgattgtggaatcattgtataccgcggtatcggtttccttcgtcattttacttgttaacagccctgcggtcatactgccgctgacatttaaggcggtgcgccccatgtcaattaacggctcaattgagatgagcagcccggcaagcgccacaggcatgttcaaagcggataggacgagcagagccgcaaatgtcgcgccgcctcccacgcctgctacaccgaatgaactgattgccacgatggcgatgacggaaatgataaatcccggttcaaacgggttttgccccactgtcggcgcaatcatcatcgcgagcatcgccggataaatgccggcacagccgttttgaccgatcgataagccgaatgaaccggcgaagtttgcaatgccttccggtacgcccatgcttttttgtgttttaatattgagcggcaaagcccctgcgcttgaacgggacgtaaacgcaaacaccataaccggaaatgcttttttcacgtatgtgatcggatttaaaccgctgaacgtgatcagcagcaagtgaatgataaacatggcgataagcgcggcgtatgaagcgatcacaaacatccccagtttcgcaatgctgtcgatgtcgcttgtcgcgatcgttttggtcataatcgccaataccccgtaaggcgtcagtcttaaaattaatgtcacgacgcgcataataatcgcgtaaaccgcatcgacaattccgctgaatgtcgctgcgtgctccggctgcttccgtttcacgcccagaaaagcgatgccgaggaaagcggcgaaaataacgactccgatggtggaagtcggtctggctcccgtgaaatcaagaaacggattccccggcagaagctcaacgatttgctgaggcagcgttttggccgtcatatcctcagatttttgctgcagctcctgaccccttgataactcagtgctcccctggtcgatatgaacggctttcagatcaaaggaaagcgccgaaacaattccgactgccgcggcaattgctgtcgtagcaatcaaaattccgatgatcagtccgctgattttcccgatgttatgggtcagtttcagcttcgtaaatgcgccgagaatagaaataaagactagcggcatgacgatcatctgaagcaatttgacataaccgccgccggcgatattaaaccaatcggccgtttgtgtcacgacatgtgaggccggcccgtaaatcaattgcagcgcaaaaccgaatacaatgcctaatccgagtgcggtaaagacacgtttagaaaaggaaacgtgttttttttgcatcacaaacagacctgctataaacaaaaacaaaataaaaacatgtaagattacaaataaattctccaaaacaggtaaacactcccttgctcattatccttaaacactatattacatcaattccgatcggtcaagtaagaattgacaatatatgtatttttattgatttttctcttttctttccatcctttctttagtaacttatataagggtgattgttatgctgaaggaactgtttcttaatttgacgattttaatcacatttaattatctcttcaccgttctttttaaagagtcgctttcacataaagaagaccgtccgatgtttcaattactgaaggggacggtctgcgggcttttaggggtttttctgattgctttcggcttttcttactccgattccatcattgatctcagaaatatccccattatcattgccgctctttacggaggctgggtgtctacagcagctgcctttatcattatcgtggcaggccgtatcctgatcaatttcaatgccagcgccatttattctatcgccgcagtcggcatgattgcgatactttctgtggccgtattcagaggaaaaaagccgaatcacaaaaatgcgttcgttatgctgctcttttcaaatgttattatcaccctgacgctgttgttacttatgcctgaacagcctgccggggccctcgtttatttttggctcatttctaccttgggcggaatgctgtcgctgtatatcattaaacacgaagccgatgcccgccttttgttcaagcaatacaagtttcaagcgaattatgattttctgacggggatttttaataagagaaaattcgaggaagtctcgcgcgttctgtacgatcgggcgtctcaatccccctcgtctcagctcgcgcttatttatttggatattgatcactttaagcagatcaatgaccaatacggccattatgaaggggaccaagtgctgaaggaactgggggcgcgcctgaggttcttactcagcagttctgatccgtcagcccgcatcggcggggaagaatttgccgtgcttatgcccaattgcacgtatacaaaagggcttcacctcgcagaagaaatcaggcacacgattgacgcgaacccgattctgctgacgagcggagatacaattcccgtgaccgtttccctcggcatcgcgcattatccgacaaatacatcggatcctcagacattgcccctgatcgcggaccggatgctgtacaaagcgaaaacatcagggcgcaatcaagtgtgcagcactgaaaaaaaagaatgatcgcccgaagaggaaatcattctttcttttcagtgagaaagccgcccctcaggaaaacaggaatcaggctgccctcatattctttttcaataaacgccgcggtatcatctgattgatacaaagacaggagtttttgcatccgttcatcatctttatcctcagccctgacggcgaccagatgaatatacgcttccttcatttgcgccgatcggatcagcgcgtccttctccgcatgaaatcctgctcttttcgcctcgctttgactgagaactgctgcgtcagcatgttccgccgcctgatatgcgttcttttttgtttccgtttttaaggtcagatgcttcgggttgtccttgatcatatcagttgaacccgtaccggtgaatccctttttcaatgtcatcagtccggcctcctgcatgagaaaaagcgccctgccgaaggccgccgcttcaccaggcacggcaatgaccgctccgtccggtatatcctccagccgtttatgttgcttggaatacacccccagcgatgccgcatatgtcgttcctaaaggagccagcttctttttcacatgaggcggcaaagattgaaaataagaaacggattgaaacgcattggcatcgagatccccgcccgcaagtgccaaatcggcctcggcataatccgaaaacattaccaaagaaagctgcaatccttcctcaccggcttttttcgcgacaaactcccagatcgattgatcagatccattgattccgatagtaattgtccggttcccgtcaggataatggcatgaagtaagtgacatgatcaaaatgaaaagaaacagactgtttataagccgcagattcaagttgacctactccctatctatttttatgtacagaagctgcaccatggtattcgggctcatgattacatacaataccgattaaaaaaagggttgtcaattgcttccttaagaggctgcaaagcgatttttctcagctgaaaatgggctgttctagtctcaaatcagatttccgtatcagagcgttctcctcttaaaacatgttatttcgaaaaaagttacatttagcagttgttttttcttcgaattactggtagagtaaaggtaattatttttgttcgaactatctttaagaagaaagttttgtaagagttttcgtcttggaagtttgttttagagcaagaatagtgaatttaagcgttatgtcgctttaggaggaaatttcatgttagaaggtaaagtaaaatggttcaactctgaaaaaggattcggattcatcgaagtagaaggtcaagacgatgtattcgttcacttctctgctattcaaggcgaaggcttcaaaactttagaagaaggccaatctgtttctttcgaaatcgttgaaggaaaccgcggaccacaagctgctaacgtaacaaaagcataaattgtttaaaaaccctgccggtgtacgccggcagggtttttttcatctaaaacgaaaagctgttttgcaaaggcaaaacagcttttttatatcaggtggcaatatcgcgttttaagaagacgccgaatgcgagcgccagaaaaataacgaagtaaatcacaagcatcacaaccgaaaatgtcatcgtcatcccctctactaaaggagtcccgttcatatattgcgacaaatccgtattggcgaataaaatatatttggtccattcaaatttcgtagcaagaaatacagtcgccgtgtttcccataaccaatagaaaaatagaaaatccgaccgctaatgagctgttccggaataccgcagacagcataaacgccatcgtcgcaagcataaaagcggagacagattcatagatatatgttttagcgaggaaggcgatgatattttgctcaaaaacatggccgtctttgtatacgagatgaacatcagccgcagtatctccccctgtaccgaaaaagaccaatcccaacagagcggagccggcaaataaaatcacaagcatcagcagtccgaacagcagcaccgtcatatatttagatagcaaaatctgaaaacggctgagcggacggatagcaagcagcttgatcgtgccccagttgaactcattcgccacaatgcctgcggcaatgataatcgtaaacagcccggtcaaaacagtcatcatcgaagaatcagctacgtatgaccacactgtataccctttatcctcagggatgttatgatccatacggtattgatttatcgcgacattctgtttcaggttatcaatgagagtctgatttccggtttccttcatctgctgtttcatttctttgttttcggcctggagctcctgtttccaattcggattggcttcgctcgaggtgaaatggtttgacagaagcgcaaaaccgatcatcgaaacgcctaaaattacaatcatagcccatgtgccgacgcggctgaaaatttttatccattcattatagatcagcttaaacatattgaacctcctctttcgtcccgccggtaatctccaagaaacggtcttccaaagattttgtcatgattttcacttcatataagcggatgttttcacggacgagcagtgaaatcacatcaggtacttcctgttttgacagcctgatctcaatgccgtttgtcttcttcacacagtcaaactgactcagaacggcaagagcctcttctctttgttcaagatggaagaagtatgtatctttatcctcttttccttcatcccttactttttgaatatcgacaagctcccctttttgcagaatgccgattcggtcgcacattaactccatttctgacagcagatggcttgagacgatgacagccattcctttttcacgtgtcagctttttcagatggtccctgatttccctgatgcccgcgggatcaaggccgtttgtcggttcatccagaatcagcaccttaggattatgcagcaggctttgggcgaggccgagacgctgtctcattccgagagagtaggtttttactttgtcatgtattctgtcctgcaacccgacgagctcgatgacctcatctattttttctttcgtaacgccttttaccatccttgcgtactgctgtaaatttttataaccgctcaggaatttgtacagctccgggttttccacgatggctccgacgtgcctgaccgcttttgcatagtttttcgtaatggattccccgcagattacgatgtctccctgagacagtttcattaatccgaccatcattctgatcgtagtggttttccccgctccgttcggccctagaaacccaaacacttcgcccgcccggacggagaagctcagatcatgaataatcgttcgtccttttatcgttttctttacctgttgcagttctaataccgtttccaattagaatcccccttctatttcgtgcgcctgcatggcgcttctgtaccattgcagcacggacattccttcctgttcccgaatttcttcgacctcgcgccgttcagcgattttcccttttatgaaaaccatcacttcgtctaacagcgtctcaatctcgccgatctcatgcgtggcgatgacgacaatctggctgtcaaaatcaatataagatacgagactgttgacaatcgattctctgaccgccggatcaagacctgaaaacggctcatccagcagaatgacggatgcttttctcgacagggtcaaaacgattttcagcctgccccggctgcctttggacagctcttttatcttctgcttcgctgaaagattcatttccgttaataggttatgtgctttttccagctgaaaatccgggaattgcgaatgataaaatgtgagcatatcaccgacggtcgtccgggcgaaaaacatatcatgttcggttaaataagccgtacgaaacagcatgttcctgcttactgcgcagtctccgatccggacggcgcccgaggtcgggaacgcaagcccggcaagcattttaagcgttgttgatttaccgcttccgttcggccctaaaattccgtagattttacccggagacaatgaaaatgatacatcgctgaccgcgagcctgcggccgtatttttttgttacgccttcaaaatcaagattcatcgtttccttcctccgcatattgtttgatcccgtcgatcatttcctcaggagataaccccagctccgccatttcctgaataaagcgtttgaaaacgtctttagtcagcctgtctttcagctccgctttcagatcggacctttccgctataaaggttccctgtcctcttctcgtctccacgatccccagcctttccatttcactgtacgttctttgtatcgtattcggattcactttcatctgtacggccatctcccttacggacggcagtttgtcccccggtgaaagctcacttcggatcagccggtaatatacacgatcggcaatctgcagataaatcggcttggatgactgaaattcattctccatcatcacacctcaacctttcgattcagcagcatagaggccagcgcgagacagagcgccgcaagcacgatcactgccaggaagctgaaaagcgagatgtggacggccttcagctccaccgtccagccggtcaattttgtataatgaaaatcaaaatccgcatacacttttaccggccataaatcatgttgagatgaagtgaatggcgtaatgattttatcgtcaatataggtccagacaaacgcaagcacgatgcagatcacccaccggaggacgggaacatgttttaatgagtgaaaaacagtccaaaagacggccacgatcacagataaatacgctgaactgatcagcaggtaagcattcagtccggttaatgtgccggccaggggaatggtgtgttccagcgctccttttgcagaaagcatccggtacatccaaatgccgtaaccggtcagcgccagctgcccgatcaactgatacagcagtgaggccgtcagcttggaagccagcagataaaatcctccattcggattgtaaagccacagctgattttttccttctttatgaaggtgatagtacataaaaagcggcgctacaagaaattgaaaaaaccccattgccgtaaaaaagccgaaaatgacgagcggttctttctgacgggcagcgatgacgtgggctgcaaacgcccagcaaatcatgccgcaaagccacaccgcaagccaaatccatgaaactttcgcatcttttttcagcaaacctaaaaacgatgtcattctttctctctccattcggatcaagtgtatgagtaacatagtacactagatcatcatgtattacaatatcttcaataaaaaaaagacaaatccgctcttacgcagatttgccttttcaattacttctttttgttttttaaggagagcagcgcatcacgatagctgctatcctgcattttgccgccgctatcaggatcgtttggttcctgatccgtctcagaagtcttaaacttctgaagcgcctgacggtacacatcatcgcccattgtattctttttctcacggggagattcagattttacaacgacgggagcatgctcggctgagcgctcctcggccggatcatgcttttccggctgttcggctgtagtgccgatcgcttctctcttttcttctttgacatcctgtcctgcagaagtgctgcggacattgaatgtgataagaagtgcaatcacaatgacagcagcaataaccgctataataatggccatataaccctctccttactgtcgtccggcagttagattacctgtgacttggctgacacgtctgccaagcgcacggcctaattgaaggccttcttccgtcatcagcacatcgctgtcaaccgggcatgtgacgcccgcaccgtagtaagagccgtacagcgcgttttcaggaacgttgccgggaagtccgacaacaatcatgccttggtgaaacataggagtgatcagattgtgcattgtcatttctaatccgccatgtgttgtcgccgtcgtacagaatacggcgccgactttatcaatcagctcgccttcagcccacagatagccgagtctgtcgatccacgcttttaagcctgaactgatggtgccaaagtgtcccgggcatccccagataatggcatccatgtctttcagcttgcggatgtctgcttgatcgacatgatcgatcaggacttcagcctcagcgttttctcgtgctccttcggcaatggcttcagcaaggtgttttgtatgttcgccttcactatcgtacactacgtaaattttcattcaggaaacctcccattcagatgattaagattccttcacttctttaggggccggaagcaatgacagctcctcttttttcttcgcccgctgtttgtctttccgtacgtcacgcaagaacaggctcaggactacgccgataaccgcaaagatcgtcgcccacataaacgcgtcattaatccccataacgttggaattaagtgaagctgttttgtagagataagaataaacggtttgtttcgccgcatcaagcgacatgttcatgttgaccattaaattcgaaaccgcgctttggaacgattgcatgaagcttggatcagccgtgctcgttttatccgcaatctgcgaatagtgcattgtcgtacggttcgtataaatcgttgtgatcaaacttgttccgattgaaccgctgatctggcggagcgtgttgctcatcgccgtgccgtggctgttcaaccgtgccggaagctggttcattccggctgtcataacaggcatcattaacagtgacataccgaatgcgcggatggcatagacaagcataatgtgcgtgtaaggtgtgtcaattgtcaattttgtgtactggaatgtcgttgcgaccgtgatgaccagcccgataatcgcaagcggtcttggaccgattttgtcaaacagaataccggaaatcggcgacatgatcagcatgacaatcgcgcccggcaatagcaagaggcccgattgcagcgccgtaaagccgactaagttctgcaggtaaattggaagcaggaacattcctgtgtaaagcgcaacggtaataatgatgttaatcacactggaaagtgagaaaatatcatatttaaatacccggaagtcgagcatcggtttttcagagcgcaattgctgaatgacaaacgcggcaatcgcgatgacaccgacaatgacggtagacagcacgatcggatctccccagccgtcgctgcccgcttcactgactccgtaaagcaatgaggcaaatccgacaatggatagaatcgcacccaagctgtcgagtttgattttttgcggttccaccaagttcttaaagaggaagaacgctatgataataacgattgccccgatcggaacaagaccgtagaacataatgcgccatgtgtaatgctcgatgatccagccggaaagagtcggtccgaccgccggagcaaacatcatcgcaagaccgaaaatccccattcctttccccctgctttcaggcgggaagataagcagaatggttgtcatgaccagcggctgcaggataccgccgccgaccgcctgaattaaccggccgatcagcatggttgagaagttaggcgcgattccgcagactaacgttcccgctgtaaaacagaacatggctacgagaaagaggctcctctgtccgaaccgggtaattaagaacgcagataacggaatcaaaacaccattgaccagcatgtatccggtcgtaagccactgaatcgtcgtcgcactcacaccgaactcggtcattaagtgcggcatcgccacgttaagaagcgtttggttcaagatcgccaggaataacccggccataagcacaataagcaatgttttaggactttttacttgattatctgatttagccacctaagacaacctcccttcatggtttgatgactgatctgtattattcagagatttttacagatgcgttcataccaggaagcaccttgtcagatgggttgctgagtgaaattttaacaggaactttttgcgttacttttgtgtagttgccgcttgagtttgaagaaggcagcatatcaaatgttgaatttgtcgcataaccgatttcttctactgttccgtcaaatgttgtattagggtcgccgtcaacaattacgtctactttgtttcctacttcaatgtctctaatgtctgtttctttaatgtttgcagtgatgtaaaggtgtttcatgtcaatttcctgggcaattgtcgtaccggcttgcaccatttggccgtttttcacttcgtttttcacgattgttccatccatgatggcttttacgtcagcattttgctgtcctttgatttttgcaacaacgtcgtttttgcttacttctttcccctcatcaaggttccagtcagttactttacccgcagcaggagctgtgatagcagccatgtcgccggcaacttttgcttcatcggtttttacatagtgtgtgctttgataatagtagtaagcacctccgcctataattgcaagaacaacaatcaaaccgataatgttggtcagaattaaacgtcctctgttcattttgttttctcctttcgtttcttcctctatcattttgtggaatgatgataaaaatatgtggggatttttttattttccgtttttcactgcacagccgtttgcaagcttcgttaaactttccgcaagcttgcgcaggtactgcagttcagcggtattgagctgccggtataagaccgccgctttttcggcatattgaacagcagctttctttagaagttcttccccctcttcggttaactgaatcataacaacacgccggtcgtcgtgatagtcgctccgaaccattaggcggcgcttatacagaatatcggtcattctcgtgacagacgccggtttcagatcaagcgacaaagccagccttgaaagctgcgtgcttttgctcttatgtattttgaacatcagcagatactgcagcactgtaatatcaaaaggttcaagaactgtctccagaatcattttctgctttttgtaaatcgatctggaagtatcaaacagttgttcaaaactgagcaaagcgagctctgattcaatcaccgtattttcacctcattcccttaataatagttcacaagataaaatattaataaatgaaagaaggtttgtaaagagaaaagtttcattttttaaggattttttttatgccgttttttctctttatttttaatttaaaaaagccgggtgaagaaccgcggccgcacgattcttcactcggctttatatttcatacgatgctttgcttacaccggcttcctcatttttaaaaaagcttttcagcgcttgaaatacgtctgatttctgtttcaggatgtagtatttaaatttatcatctttgacatttttataggcggacatgagggtggaatgcctgttatattgattgacctcaccgtaacagaacagattcgattttttcatgatgtcattgacgagctttacgcaccgggcgttatccgaagtcaggttatctccgtctgaaaaatgaaagggatagatattgtagcgggcggggtcatatttttcatcaattaattcaagagacttccggtaaacggaggaacagatggtgcccccgctctcccctttcgagaaaaaatcttcttccgacacgaccttcgcttccgtatggtgggcgataaattcgatatcaaccgtttcatactttgtccgtaaaaatcgtgtcatccaaaaaaagaagctcctcgccatatacttttcccatacgcccatcgaaccgcttgtatccatcatcgctaaaacgacagctttcgattccggcttcgtcacatcattccatgttttgtatttcagatcttccggataaatagggtaaaacgacggcttgcctgtcatggcgtttcgtttataggccgacagcatcgtccttttcttatcgatattccctgtcagcccggttttccggatatcattgaactcgatatcggtatggacgatattgtccctttccttttgctgcagattcggcagttctaattcctgaaacagcgcttcttccagatccattaatgaaacttccgcttcataataatcctcgcctgcctgatcgccggctccctggccttttccagccccttgctttttatctgcgccgtctcttgcgacgacatcgccgacttcgctgtcgccgtcgccttggccgacatgtttatttttatcatagttataacggattttatattcatcaagcgaacgaatcgggattttcacgacatcttttccgttggacataataatgctttcctcagtgacaagatccggaaggttgttttttatcgcttcctgtactttcttttggtggcgctgctggtcgtcaaagcctttgcgatggagggaccagtcttcctctgaaatcaaaaaatttccgctgtcattacgggacatgaattcccctccttaaccgttatggtcgttttacatgtgtattccggcttggtcctgtttatgaaacaagtccggcgaaaagatttatttttatcttatgccggccggactctccaattgacaaacaattgcgaaaaacagacaaaagaacccgtccttttacagacgggcctctcaatgaaatcaaacatcagcggtttaacaagcttccgacatatttcagcagttcattagcgcttgtcgaattatagccgtgttcatctattaaccttgccactacctcattgacctttttaagctgctgttcatccggcgttttggtggaggtcgtaattttcactacatcttttaagtctgcgaacagctttttctgaatcgcttcgcggagcctttcgtgcgaattatagtcaaagcgttttccttttcttgcataggcggatatgcggattaaaatttcttcgcggaacgcttttttcgcgttttctgaaatgccgatctgctcttcaatggatctcatcagtttttcgtcaggattcatttcttcacccgtcagcggatcgcggagcttatttttattgcagtacgcttccacattatctaaataattgtccatgagagttttcgcggattcttcatatgaatagacgaacgccttctgcacttcttttttagcgatgtcatcgtactctttcctggcggcggaaataaaattcatataccgctctttgtcctcggcggagatggacggatgctggtcaagtccttcttttaaggaacgcagcacgtcaagcgaattgatcgattccatattttttctgataattgttgaggaaatgcggttgatgacatagcgcgggtcaattccgctcattccttcatcatggaattccttcttcatatcctcaagatcaacggaattgtaaccttcaacgctttctccgtcatagagcctcatttttttgacgagatcaatatcagagcggttcggttccttcagccgggtcaaaatagaaaacatcgcggccacttttaatgtatggggggcgatgtgtacgtcagaaacatcactttcagaaatcattttttcataaatccgttcttcctctgacacctttaaattataaggaacaggcatcacgatgatcctggagtgaagggcttcatttttcttattggcaataaacgagcggtactccgtttcgttcgtatgcgcaacaaccaattcgtcggctgagatgagcgcaaaccgtccggctttgaaattcccttcctgcgtgagtgacagaaggtgccacagaaatttttcatcgcatttcagcatttcctgaaactccatcattccgcggttcgctttatttaattcaccgtcaaaccgataagcgcgcggatctgattctgatccgtattcggcaattgttgaaaaatcaatactccccgtcaagtcggcgatatcctgtgatttcgggtcagacgggctgaaggttccgattccggtacgtttatcctccgagaagaatatacgttcaacctttacatcctcaattctgccgccgtattcttcttcaagccgcatgacattaagcggagaaaggctgccctcaattctgatgccgtattctctgtagaagtcgtcgcgcagatgatggggaatgagatggagaggatcttcatgcatcgggcagcctttaatggcgtaaacagcgccgttgtctgtcaatgagtaggcttcaagcccttttttcagcatggtgacaagagttgactttccgccgctgacgggtcccatcaatagtaaaatccgttttcttacatcgagccgcttggcagccgggtgaaagtattcctccacgagccgttccagagattcctcaaggccgaacagctcccgcgagaaaaagctgtatgtctttttaccgtcatcctcctcgattccgctgtcttttatcatattaaaaacgcgagaatgagcagactgcgcgaccaatggattttcttttatgatctccaaataatcagcgaacgtcccttcccatttgagacgctgctcttcctctctgtacttttcaattttctttaatatatccataagaacctcctctatcatggttaatgcactagaaataaggtactttgttacaatctatgcggtgacgtgataatacatgcttttcgtttcttaaaaataaagacgttacaaggccgtcattgacaagggtccggtgcaccgttcataatgaaagaaatacagtttcatccagactcggacatcaaatggaaaagcaaagaggaggagaaatgatgaaaacgatcattttacttggggtcattctcacttttttagtatccatttttacggcgggttacgacagcaaacctgaaaacaaataacggcaaaagggtgctctttatgaagagcaccctttcctatacaacataacaatgtttcatatttggatatgttcttggacagttgatttttcatgagatttgcagcttgtttgatactcgattttttcgattttgcaacccgggccgatttccacatgtttccctctgacgatgtccgcttccgtgtattcgagataaattgcgtctccttcgatcaattcagcagaaagcgtgccggctttccgtttaagaaaaccgggtttccgtctgacggtgatcgatgtgccgccgatttctttcacgcggcttcggtcataacgcaaatggatgtttacgtcccccgcgtttaacaatcccgccacattgatacatcctgttacatgaagcagctccgtctcgcaatcgccgccgacggtgagactgccttttatatgacactgctctcccgcggccccgccgccaatttcagcaagtcctttcagcctcatcgtggcgaaacgcacggagccgccgactttcaatgtgccgatcacatttgctgaacgtgctgataaatctcctgcaacttcatgctctccgaaaattttcagcctgttgatctcggcatctccgagaaaaagtcccgtaccgaatatccggcagcgttcgctttgaagtccttcgccgacagttccttcccctttaatgcttacattttggtaggaaccgccggaggcgtgtccggctccgtacatttttaaatgactcaatttttttgtcgtttccatcgcagctcctcctatcgtttcacgactttgttaaccaaagcggaaggatcacatgtaaaatcgccgctgtattccacagtcccaatggtgcagcctgcgccgatctgtacatgatttccgcggactgtcttcgcgttcgtgtccgccaattcaatgatgtcaccttcaatcagctctgctgtcagcaccggggccggcatcagcttaaaacgcgtaagcacgctctttctgctcatcactttcaaatggcggcatccaatttctttcactcggctctctcccgccgtcagcttaatactgacttcatcggcattcagcaggccgccgatcttgcatttgccttccgaacggaacgtctctgtctcgcaatcgccttcaatcccggctttcccggatatgaaaatatcatcagctttcacaccgccgccgaaagatgaaaatcccgcgacgttcagccgctccgttttgacatcacctttaatgacacccgttccgttgatacggatggattcagcttcggcactgctggaaattttccccgaaccgctgatcgtcagcgtttgcgtcttgacatgtccgtctgtttttccgctgccgttaaacaaaaagctcgcgcactccacatcacctgacaccgtgccgcttccgttgatctccactgtatgaaaacggcctccttttgaacttcctgaaccgttgatgattaatttatctgttacttccattgatggtcctcctgcatccatttcgtttttaattcttccgatgccgcagcaagcgccacccgttcaaccactttgacagtcggttcaaataaaatatgttccgcgtctgcgatgaagcacgtcgttacgccaagctttcggagcatgacaagctccgtatttgctttcagttcggaagcctcatacgttttcagcacccctgccgccaattttccttcctcaaggctgatattgcccgatcgcaaaagtccttcaagcacatataaagacagcagcgcgcgggacgtgaatgtcacgccgtcttcgccataaacttgcagcgcggcttttgaaatcagtcccttttgaagcagctccgcagacgttatattgacatcagtcatttgcggagacagcatttctctcatttcatccaaagacagattttctttcattttctgtatttttgagatgcgttttaatatttccgctctcggaaaaaatgtttcctggcctgtaaatgttgattttcggataaaccattcttcaggaattaaatttttccgtttccagcggtacagctgcccatatgaaattgatgtttcttccagcaattcttttttagaaatcagttgttcctccatgaatccagctccttcgatgaaagtattgtaacataacactgttacgttgttaagcctggaaatataaaaacgccgtgaaccgctgctgtccgtcttttttattcaataaaaaaacgcccggatgcgggcgtttttttcacgtcaaatctctgtaattttgctggcgcagcgcttcatatacaagaatcgcggccgtgttggacaggtttaatgatctcacatgctcggtcatcggcagacgcaggcagcggtccatattgttttcgatcaattctttcggaagtccgctcgtttctctgccgaatacgaagaaaaagtcttcctccgtatttgagtaatcaaatgatgtgtgcggcttttggccgaattttgtaatgaagaaaaactttccgttctcatatgcctcaaataactcttccaatgaatcatgatatacgacgttgacgaactcccaataatcgagtccggcgcgcttcagcattttatcatcggtcgagaatccgagcgggcggatcaaatgaagcgttgtgtctgttgccgcacaagtacgtgcgatatttcccgtattggccgggatttcgggttgatataaaacgacatgtaatgccacgatgttcacctctgttttttattccgcccaccattatatcattaattactcttttgtcgtatcatccgtaatatgaaaaaacgcatatctgatggaaggagtatacgccgttgaatcctcatatgaccaatatctcattctgctgtcatacgtttgggcattgacaagcggcatattgcttttatctttcgcgaccacgatcgccgtatgattaaaacggccgtccccttcaaaatcatagcaaataatatctccgggcatcagttcttcagctcttgatacttgcaccgcgcgaagccctgccttggattgggccagatacatcttcatcgaatgcgcgaccgtccagctgtagctccacgagcttgccttcatccaccagcctgagcctctgttcggatgcccccgcatcggtgcttttccggcatgtaaacattgggaaataaaattggtgcagttgtcgctgaaatttttataagcgggatttcgtttattccaaaacttctccgcatactgcacggcagccagacggtcatattgaaacgcccgcccgaaatcttcccgttcactccgctcatattcaattacactgtttccgtcagaaaatcccgccggttttttctttacttcccggtctttaatcaaaagccgatcatagagaaatgcagtccgttcctcaatctgctcttctaagtaaaggtgtccgtcatgctccttgcacaaatattcgaaatgaatcgtgtacatgacgcataacgtgccgtcgtcctcaaggctgcttttgacaatgacggcttttgccttcgctttcacgatgtcaactttccgtttttcaaacagctctttttttctcgtcaggacctcaagatcgccgggctgcccattgtgcctcatctcggttccgttgattaaataatgaagccgggcctccgctaaatcttcaataatatgcttcaagcgctccacccaccatactgttttataaagaaaaacacttgaactcacgccaagtgctttttctctatacatatgtcaggaccggccggttttagtcttatcagaaaccgataacagctccagtcccttttcaatttcccgtatagcttcctcatcctgctccttttgaagcgctttttctaattcccccgcataatcaggatcaccgattttcccgatggcccaggcggccgtccccctgataacggggcgtggatcttggtgcatcaaggccgttaattccggaagagacgaggcatctttaaaatgagccaaagctaaaatcgcattccgctgtatcggcttcttgccgcgccatgatcccgatacatgtccgaatttttctttgaattcgcggttgcttatggtcaaaagcggctttaacagcggctttgcgatttccggatcaggctccatctgcggatgaagatgaaaatctttccccttattaatcggacagaccgtctggcacgtgtcacagccatacagacggtttccgattttcgtgcggaactcatccggcaaaaatccctttgtctgggtcaggaacgaaatacagcgctgggcgttaagctgtccgggattgacgagcgcgccggtcggacacgcgtctaaacattttgtgcacgtaccgcacatatcttcaatcggcacatccggttcaaagggcagattggtgatcatttcagccagatagacgtaagagccgtattcaggcgtggtgatcatgcagtttttggcgctgaagccgattcccgcccgttcagccacggccctgtcggacaattcccctgtatccaccattgactttgtgcggatatcctcatgtttgctttggagaaaattctccagcagatcaagcttttccctcagcacgtcatgataatccttcccccaggaagctctgcaaaaaatgccgcgccgcccgtccctcgtgctcctcggcgcatctttcattttggaaggatacgcaagggcgatggcgacgattgatttggctttcgggagaagcaaagacggagtaacccgtttttcaatatccggctcttcaaaaccggataaatagccgagtgattcctgaagaatcagccggtcccgtagactgtcgaacgtatcagccgtcgtaaacccgattttgtcgactccgatgcttttggcgtattcgattaattcctctttcagtttatgaatattcattttttgcacagcctcctttctttgtgatcaggctcccgcacaggtataatagagttttatcatcccgaaatggagtgaacacacttgaacatcagtttagatccacttattgctgaacgggtgccggggatcaaagcggcagccgtcttatatgaacagatcgaagtcgggcctgctccgcaaatgctgaaaggccgcctccgtttatttcaagaatctctttactttgattatgctgacgggggtatagaagagcagccttttgtaaaagagtgggcgcgtataatggaacagctcagtcccgccttttcaggacaaaaaacgccgatggagcttatgctcggcgatatttcccgggaacgattcattgaaagtgtgaattcagcccatgataccatactttttttctccttgaaatattcattgcctatcatggcgtatgatgccgcagaaatagatcaaccaatttcaattacgatcggagaaaaagaaagcgtactgtctttctccggcccggacggcgttttcggcgacttcaccggacatatcaatacacgccctgtcacgcccggcacaaagaaaatgctgcagctgatctttttcccgccttcatttcatgccgacgcggcggatgagctgctatcatccttaacaaaaatgtttgaacaaattcacggaggcacgcataccgtctcttggctttcataaaaagacacgccttcgtgtcttttttcacataaaaaaacgcaatacttcgtttatcagagaaacgaaacactgcgttaataacgtatgtatggagcgggtgatgagaatcgaactcacgacatcagcttggaaggctgaggttttaccactaaactacacccgcattaaaattattttttgtcagtaccgatttgatgtttctaatattacatgtttatttttttttcgtcaagggaatgttaaaaaatttgtcgaaaaaagttctttttttgtccacatgttaagttgggtttacattttgttaagagtctcatacaatataaaaaagaagaaaacttgaggtacgcctgatgatgaaaaataaagtaaaagagctgagagccagattcggctattctcaggaaacgctcggaaaagaagccggagccaccagacagacgattgcagcgattgaaaaaggagattatgtgccttcacttttattggcgcttaacatctgccgggctttctccctgccgatggaggaagtgttctggctggaggaggagaaaaaatgagtttgaaaagaaaagcgtgttttcaccttgcactctacggattggcctgctggacgcttatttcctttatggaagcggcgccgcggatcgctcagtttttccaaacggaggggagcggttcatttgagctgaatatcactccgtttctgctgtttaccgtttgtgccgcattgtatatctatgccgaaaagaaaaaacgaaacggcaaaaagcacaggcttgtacccgatgaatttgaggaacaggatgaaagagaacgaatgatgacggctaaagcttgccgttcctcgtatatcgccgtttacttctcattgccggccgcagccgttctgcttttgttttatccgctgattcagccgcatcttcccttttttccgattcttttgattttcattctgatgatgattcagcatttggcttatgctttcacttttcataagcacggcaaaaactccggttcatgacagatccggagttttttacattaccagctcgcttttttcaccccgggaatccggcctttatgggccagctccctgaatgcgattctggacagtttaaattttctcatatatccgcggggccgccccgtcaccgtacagcggttatgaagcctgcccggagcagaatcacgcggcagtttgctcagcgcttcccagtctccttttgcctttaattctcttcggatgtccgcatattgttcaacaagcttctgccgcttgagctctttgatcacttttgatttttttgccatttcagcactcctaacaaatcgtaataattacgttttgtatcatatcatccatattagcatcgtgcaagctaagcgcttaaaaaggcgggtgaatacccgccttcactgccggcatttccccggaaatgaatccgcagaaagcgcccgccgtcaattatccgccttgcgacgtcatcagactttcgctttatttcctcttgcaaaatggtcgttgcccattgcttcacccagtctgcgctcaagctttttagtccgttcattctgaaacggcagaagcggaaacacgagttcagacagataataagcttcttccagatgcgggtagcctgaaaagataaacgactcaatgccgagtgcctgatactctaaaattcgagcagcgacagtctgcggatcaccgacaagtgccgtgcccgctccgcctctgaccagtccgatgccggcccagagattcgggctgatctcaagcttcgagcggtcaccgttatggagatcggccatccgtttttgtcccgatgaatcagcgcgccgaagcgcagcctgcgctttcgcaatcgtctcttcgtctaagtggctgattaatcgatcagccgcttcccatgcctcttcctcagtctcccggacaatcacgtgaagtctgatgccaaaacgcatcgtccttccttccttggcagcctgttttttaacggtttcaatcttttcttttacctgctccggcggctctccccatgttaaatagacatctgtatgtttcgccgcagcttcaattcccgcctgtgatgaaccgccgaaatataatggcggatgcggagactgctttggcggaaacagcagattgctgttttccactttgatatggtccccttcatatgtcaccgtttcgccccgcatgagtccgcgccagacggttaaaaattcttcagtcgccttataacgttcatcgtggctgataaacatgccgtctcccgccagttcataaggatctccgcccgctacgacatttacgagcaaacggccgtctgacagccgatccattgtcgacgccattctcgcggcgacagacggctgcatcagtcccggacggaccgccactaaaaatttcaagtcactcgtttcccccgctaaagcggcagccgtcagccacgggtcttcacatgatctccccgtcggcagcagaacccccgtatacccgagtctgtccgccgcctgtgccacttgcttaaaataaagatgatccgccgttctccctcccgtttgcgtccctaaataccggccgtcaccatgggtcggaataaaccaaagaatctccatatgaatctctccttttttaataggttacccttcataactgttccgccattttaatagtttccgttcgagcattctgaccaatgcatctgtcagcttgccgacagccgcaaaaatgataatgccggcaaacaccttatttgtctgtgaaaattgtctggcatccataatcatataaccgacgccctcgctcgatcccatcagttccgccaccacgagaccgagccacgcaatgcctagagagagcctgatgccgagcaggatattcggcagagatgccggaagaattaatttcgtcatctgctgataccagttaaattccagcacccgtgcgacgtcaaacagcttcgcgtccacactgcggattccgagaaacgtattaatgtacacggggaaaaatgcacctaatgcgatcagcagaatttttgatgtctcatcaaacccgaaccacaaaataaacagaggagtcacggccaagtgcggaaccgttctgagcatttgcagagacggatctagatatgcttccgtccgctttgagaaaccgaccagcagcccgaaaacaagtccgaggcccgcgccaagcagaaatccggcagcagccctgtataaactgatctctaaatgaccccaaagttcacctgaaagaagaagttcctgaaacgtctgcaagatgacgacaggtgaggggagcaccgtggccgagacgatgcccagacttgcgataaactgccatactgcgatgaccgcagccgggagtacaatccctttcatccattggtatgaatacttccgggatcttgccagagctttcttttctgattggcttattgcgccggcagccgttgatgcttctgctttcattacttgccatcccccgtttcaagcgcttttttaataaatgaattgtcgacaacgtcttttacatgaattttcttatgaatcgcttttgtttgatattgaaaatcagcggtttcctgctgggctttgacaatatcatcattgatcggttcattgagaggctcagtattgttaagcacgtttctgacgactttcggatcaagatgtttgattttcgcatataaggagacagcttcatctttgtgttccttttgccatgcaactgctttattgaacactttcagaaaacggaccacctcatccgggtgttctttggaaaatcccgttctgactaacgtgaaaccgggagaatataaatctgtgctttctccgttcgccaatatttccgccccgtgctgcagcgtttcaattgacaaatacggctcccaaatggaccatgcgtcaactgatttgttttcaaaagcggaaaccgcctcatcaggctgaagctggatgatggtgacgtcatcggcggaaagccccgctttatctaaagctttatagagaaaatcaaagccgctgctgcctttggctacagcgatttttttacctttcaattctttcaggctctgaatcccgctgcccttgtttacgagaatgccgtttgcctttaacccgtcctgagacagcccgatctctttaaaatcaatccctgccgcctgaccggaaatgaccggtgaattgccgacctgggaaaaatcaagcttatcggcggcaagaccttcaaactgcggaggaccgctttggaattcgacccattttacttttattccgtcttttttgaaggcctcttcaaaccagcctttttccttggcaatgagaagcgggcttaaactctgctggatgccgatccggatttctttcaccgttttcccgctccctcctgtcctgtctgcactgcatccggctgacatcatgactgctgcggctaaaagaatgatgatttttttcacttcgcttcgtcccttctatattccggacccatccgcaaaccggaggtcttccgttttctcaaattcagaaagcaccttctgccggacggcctgaaaatccgctgacgtccgattgcgcggattcggaagctgaatcggcatcaggctgtgcagccggccgggctttgccctgaggatcgccagcttatcgcctaaatagacggattcatcaatatcatgcgtgaccagaatcatcgtcgtttttttctcgcgccatatatcaagcagcacatcctgcaaatgttttctcgtaaaagcgtcaagcgccccgaacggttcatctaaaagcagcacctccggctcacgcaaaagggctctggcgatggcaacccgctgcgacatgccgccggataattcgcgcggataagcgttctccgctccctgcagcctgacaacctcaatcagatcatccacttttttccgaacggccgggtcgttcatattgagatcggcagcgatgttttgttttaccgtcagccagggaaacagccggtgctcctgaaagataaatccctgccggatgcccggtcccgatacattgcggccgtttattgtgacagagcctttataatcggtatcaagaccggcaatcaattttaaaagcgtgcttttgccgcatccgctcggcccgatgacagtcaaaaattctcccgatgcaattgacagctcaatatcattcagcaccggcgttttccggccttcatgctcaaaagctttttcttgtatgctgatggttacagccatctgtcttcccctctctttctgccgcgtgcgatcgaaaaacaaaaaggcccccatctccgattgcttgcagagatgggagccttcggcggtccgatcggcaacccgtttgtttttaaatttgaatatcatgttaattcaaattattccgacttgtcaactgttttttataaggattaaaatacgccctccggcataaccctgccagagagcgcatcggctgtatcacgtatttacttccttttcttggcgggcgattttcaataatgtccgcgcgttgttgccgaaaatgttctctatatcttcttcccgcatattgatttcccggcaggtcctcacctgctcctgaagatatctgtatacatatcctctcggaaatccgttcgaatccgtcccgaagatgatccgttcagcaccgattaattcagatgtcttccgaaacagaatttccaaatcaagcgggtacggcatccacctcatccactgatttgagccggacgtgtcaatatacacattcggacagctccagcacagctgcagcagttcctgataatatccggcgccgaaatgcggaatgatgaacgggatatcagcatactctctcgcgacgcgatagatggagagcgggttgatgttgcgatggctgacaatgccccccgctcttcctaaaagcccgaagtgaattaatacaggcagccttttgtcagccagatacgtccacagctttttcagcgacggatcatgaaaatcgatgtctgtcagcggcccgaacagtttatatcctttcagaccgagctcttctaccgctcttttcagctcttcatacgcatcctcccgctccaaaggatgatatgcaaatccggtaaatctcgcgggattggcttgaataaacgccgccatccggtcattgctctctgctgttaaaaaattcagcacgtcaatgccgtacttatctaattcattctcccatcttgtcatcaaagcgatttcgccgtcatcgccctcaacatcatgcggatcaggaaaatcccaagtcagattcattctatctgaccgctcccggttataatcggaaaatgtcttatcgtttttgccgaaataaaggctgtacggcagatgaccgtgaatatcgacaggtttaaaatgctgccggaaaagcatacaatcgccgcctcccttaccgcctgacaataaaaaaaggcccttatccagtgaagaataagagcctcttgtgtccaagtcggcggtttctattttttctcatcttaaacccattattcccgtcagtcaagtaggctttcaaatccaaaccctttcttcgataataaaaataattattttataatcattataaaataatattgactttttactgataggtgatattatgtttttataaatctaaagaggtgatcacatgagttcaaataaattgacaaccagctggggcgctcctgtcggagataaccaaaactcaatgacggccggcgatcgcggtcctgctttaatacaagacgtccatctgcttgagaaattggcgcactttaacagagaacgcgttcccgagcgtgtcgttcacgcaaaaggcgcgggcgcacacggttattttgaagtcacaaatgacgttacaaaatatacgaaagccgcatttctgtcagaagtcggtaaacgcacgccgctcttcatccgtttctcaaccgttgcgggcgaactgggctctagtgacacagtgcgcgacccgcgcggatttgccgttaagttttatacagaagaaggaaactacgacatcgtcggaaacaatacacccgtgttcttcatccgcgatgccatcaagttccctgactttatccatacacaaaaaagagatccgagaacacatctgaaaaacccgacggccgtttgggatttctggtctctgtcaccggaatccctgcaccaggtaaccattctgatgtcagaccggggcattccggcgactcttcgccatatgcacggattcggaagccatacatttaaatggacaaatgataaaggcgaaggcgtctggatcaaatatcactttaaaacagagcaaggcgtgaaaaaccttgatgttaatacagccgcaaaaatcgcgggcgaaaatcccgattaccatacggaagatttgttcaatgcgattgaaaacggcgatttccccgcatggaaattatatgttcaaatcatgccgttagaagacgcaaacacatatcgctttgatccgtttgacgtcacaaaagtatggtctcaaaaagactatccgctcattgaagtcggccgcatggttctgaaccgcaatccggaaaattactttgcggaagtagaacaggcgacgttctctcccggcacattagtccccggcgtcgacgtctcacctgacaaaatgcttcaaggccggttgttcgcataccatgacgcgcatcgctaccgtgtcggcgcgaaccatcaggcgctgccgatcaaccgttcccgcaatgaagtgaaaaactatcagcgtgacggacaaatgcgttttgatgataacggcggccgctccgtctattacgagcctaacagcttcggcggcccgaaagagtcacctgaagataaacaggcggcatatcctgtatcaggtttcgcagacagtgtaagctataatcatcatgatcattacacacaagccggcgacctgtaccgcctgatgagcgaagaagagcgcgcgcgccttgtcgccaatatcgtcagtgcgatgaaacctgtggaaaaagaagaaattaagctgcgccagatcggccacttctacaaagctgatcctgaatacggcagacgcgttgccgaaggactcggactgccatcaccaaaataacatcaaaaaacctgccggtctgcccggcaggtttttcctgtttattatcaataaaaccgtttttttctcaattatacgaagtggcatgccgcaaaatgatgaagccctttttctgacagcgccggacttttctcagcacatatcttcttggctgccgggcatctcgttcggaatttacagcctgaaggcggatcagaggggctcggtatatcaccctttaaaattatccgctcccttttcactccgggatcaggaacaggcacggctgataacagcgctttcgtataaggatgaagcggccgtgaaaagagctcctcctttgacgcgtattccacaatcgtccctaaatacataatggcgaccttcgtacataagtgctccaccacgcttaaatcatgagaaatgaacaaatatgacagcccgtgctgtttttgaaggctgctgaacaaattgatcatctgcgcctggatggagacatctaacgccgccacgggttcatccataatgataaattgcggcttgagcgccattgctcttgcaatcacgatccgctgccgctgccctccggaaaattcatgcggataacggtcgataaagtttgcggaaagtccgcaggcttcaagaacttccgccgctttatcacgcgcgttccgcttcaccaccaattgatgctcgatcatcgcttcaccgatggcttctccgatccggcgccggggatttaaagaactgaacggatcttgaaagatgagctgcgcttctgatctgaaagttttgagctcgcgccggctcatccgaaacacatcacgcccctgaaaaaacacctctcccgctgttttttcatgaagcctcaaaatggtcttgccgattgatgactttccgctgcccgattctcccgctaagccgaacacttctcccttttctatcgtaaaactgacaccgtcaactgcttttacgggatttttgcgggtctttctcatccccccatgctcctcgtaatattttttcagccccctgacttccagcaatacatcactcatctgctttctcctctctgtaaagccagcacgccgcctgatgccccttcccgaattcagtaaaatgcgggctcgatttccggcatatttccatgctgtgttcacatcgctccgcaaaataacaagacgatcccgacaggtccgcaagctcggggacctgccccggaatggtgtacagcgtctcccttctttgaccgataaccggcttggccgcgagcagccctttcgtatacggatgcttcggatcagaaaacagctttgcaaccggtccttcctccacaatttttcccgcatacatgacaatcacataatcagccatttcagcaactacgccaaggtcatgagtaatgaataaaatagacatgcgaaattgctttttcatatcccgcaataaatccaatatctgcgcctgaatggttacgtcaagcgctgtcgtcggctcgtcggcaatgatcagtttcggttcgcagcttagcgcgacagccgtcatgatgcgctgcagcatgccgccgctcagttcatgaggatattggtgcataacctgctcggcatgcgggatctccactaacgtgatcagttcaacggccctccgccatgcttctttcttactcagcaataaatgttcgcgaatcggttcggccagctgctcaccgattgtaaacaccggattcaaagatgtcatcggttcctgaaatatcatcccgatttcgctgccgcggattttctgcatgtcttttggtttcaattccaacaggttccgtccggaaaaatgcaccgctccccgttcgattctccccgtctcgggaataagctgcatagtggacaatgacaccatgcttttcccgcagccggactcccctacaatacaaaccgtttcctcctcatgtatcgtaaagctgacatcgtccacggcctttaccgccccctcctctgtataaaaagccgtttccaaatgcatcacttctaaaagcggttttttcatttcattttcacctgccgttttaccttaggatcaaaagcgtctcttaaaccgtctccaagaagatgaatcgccacaacggtcagaaaaatggccgttcccggcggaatccacagccacggacggagtgtaaaatccataaaatgattcgccgcttccatcatgtttccccaagaaggtgtcggcggagcaacgccaagcccgagaaaactcagcgccgattcactcagcatcgctcccgccacatgcaaagtcgccgctaccagtaataacggcaatgtattgggaagcaaatgatagaggattttccgtttatcactaagccccaaaacttccgcggccatcataaacggctgctccttcagcgacaaaatctgtccgcgtacaagccgcgccagaccgggccatccgatcaggcttaacatcatcataatcaggtacatcctgtattcagaaggcactttccactccgacatcaccgcagccaaaatcaaaagcagcggcaggcccgggatggacatgagcatatcagcgatgcgcataatgatcatatcagcggctccccgataaaatccggccgcagccccgagtaaagaaccgatgacaagcgacagcaccattgaagcaagccccacggtcagagaaatctgccccgccagcatcagcctcgtcagcacatctctcccgtactggtcggttcccagccaatgatggattcccggctgctgattggcatttgaaatatccgtccgatctgttatgtacggagaaaaagacggcccgataaagcacaataaaaacataaaacataagaaaagaagactgatgaccgtcagcttatgatgcagcaggcggcggtacgtctgcttccaaagagaaggcggcacccctttttgttttttcatttcgaacaccccctatttcagcctgacccgcggatcaaccgcggcataagcgatatccgccaagaagttccccacaatcgttaaacaagacaaaaacaatgtaaacgccatcaaaaccggataatcacgataatgcacagattcaagctgaatacggccgacacccggccaaccgaaaatctgttcaataatgatggctccggaaaacagtcccggcagttcaaaagcaagcagggtgatggccggaatgagcgcgtttttcaacgcatgtttccagatgacggtgcgctctttcaatcctttcgctctcgccgttctgatataatcctgtctgatcacgtccagcatgccggagcggaaataccttgtcagcgagccgatgccgagcatagataaaatcacgaccggaagaatcatatgtctggcggcttcaagcacgtacgaaaaacctgtactcgtgcttccggtatcaatcatcccgccgacgggcaatattttcaaatccaccccaaaccacttaataaacagaaggctgataaaaaaagacgggaacgccatggaagcaaaaacaagaaacgtcacgatcccgtcaaaccatgagtatttcctgacagcggatatgacacccgttatcatcgcggctgaccatgtgacaagcaacgccaaaaacgcgacaaaaaacgaattccagacatatttccgaagcagtgacaggacgttctcctgatattttaaagaaaacccaaaatctccgctgagcacatttccgagccacgtcacatagcgctgccaaatcggctgatccagcccgtaaagcgcttttaactcctgcgctctttcaggagtcaggtttacattggaatcaatatagtcgcccggcagcatggcgaataagaaaaaaataataaaggacgtaccaaataagatcacaagcatttgaatgaatcgttctgcggcataccgtttcacaaaaagcccctcctttccgctgaaagggcaaaatccccgggatgcaccgggtattttgcccaaccgttctattgaattgagacatttgagagacttgaactgattccagaataattgtcaggctcaagcccttttatttttccgctgaccgcccttgcgctctgacggtaatgaatcagaatgtaaggcgggttttccccgagctcccggtacagctggtgataaatctcttttcttttgctgatatcaagcgtgccggctcctttctctatcagccggtccgctttcggattggaatatcccgttacattattgggatggccggaagccagcttttccaccgtgtcattcggatcaagaatctgcgaggtggaaacggcggcaaggtcatattgtttgtcatttattttcgctacttctgtattaaaatccatcacttccggttttaatgagattccgatgtccgcgtaattttctttcgagatcgggatgaaatcatcatccgctttagacgtgtaatagctgatttcaagctttttgccgtttttttcacgtacaccgtctttgcccgttttccagcctgcttcatcgagaagctttttggctttttcagggttaaacgcgtaccgattgacatctttgtcatcataagcccacgaaaccggagacaccggcacattcgcgacttctccgtagcgtttaaagcggacatcgacgattttttgacggtcaagtccgtaaataagcgcctgggacactttcttatctcgaaaaggcggacgcttgtgattgacgtacacaagcccgtaatcattcacgacagatacgcttatattggcaaaaccgagactttttaaatgctgaaccgtatcatcatcaggtgagaaagaagcgtaatcaaggtcacccgtttcaaacagctgaagggaagttgacggatcgataattttataaatcagcttttccgttttcggttttcctgcataatagtgttcattagcctgatagcgtatttcctgtcccggaaggtattctgtaaattgataaggtcccgctccgagcggtttggcataaagctcttttaaatagtccagtttgccgaattgatatttcttcccgtagtaggcttctgacagcacctgccctcccaaaagaagcagcgacttcgcactgactttctcagtcgtgatttgaatggttctgtcatcaaggacgcgaatgccctctatcgtctttgcctttccttctttgtaagccttaccgcctttaatataggccgtggtgatatcttcatagcccgcgtatgcaggatcatgcagcagtgttaaagtgaatgcggcatcctttgcggtcagcggtgaaccgtcgctgaaaacgagattttttcttaaacggaacgtgtatgtaagctgatctttggaaattttccagctttccgcaagagccggggcaggcttccccgttttatccagtttgactaacggttcaaaaataggatctgtcgcatttccgtcccagccgttttcgtaaaagtacggcagaaacacaccgcccggcgcggaaatcccagcaacaaaagtgtcagttctggctttcgatttagcgggaatcgccgccggatgagaagctttaaattcctttgtcttgacatgggcaatacgtgtttcttcctttttatccgccgcagatgacggttcttctccggcactcccgaacgcgcaccctgataacatgatggataccgacagcgcgagtaccgttgtttttatcctccattttctctccttcatctttatcgaacccccgcatgcttttcatctatctttatataaatctgctccatctgttcctcatttctcataatctcccgtttgtttttctctacaagcagttcgaaattcaatgtgtgttttctgtacttttttcgttttttgctctttttgcgcacatgtgataccttttttaacgccacttttcatccctccgcttttcatttcattcaatgactttcacgcaaaaaaggcccttatctgtttaaaagataagagccttcggtgatccgatcagccatcgtttggaaatatgtaatgattatgttaattcacacaatccctacctgtcaactataatttaaaatatcgtttccttccgggggttttcctcatacactctctcatttttccgcatatgctagaaaacatagcagattacaagtgaaagtgagtgagaatgtggaaaagacaacattgaccggtcgcatcgtcaaaaaagatgacccggactataatgctgcgagaaccaatatcaatttaagcctgcaaagatatccagacatcattgtgttttgtcaaaacaaacatgacgccctcaatgcggtgagatgggcgcgtgagaacaatgtgcctttccgtatcagaggcggaagacacagctacgaaaacttttctctgttaaatgacggactagtcattgatctcagtgaaatgaagaaaataagagtaaatgaggataagcggctggtctcgattgaagcgggagccgaattgggggaagtctaccggacactctggcggtacggcttgacccttcctgcgggaaccattgcgaatgtgggaatcacggggctgacgctcgggggaggaatcggatatttaacaagaactgccggacttacttgcgatcgtctcctccagctcgagatgatcatagcggacgaaaaagcgggtgctgacttgatcacagtcaaccgttcaaagcactctgatctattttgggcgtctcagggaggagggggaggcaacttcggcattgtcacatccatgatgtttaaagccgtgccgatctcgtgcgtgtctgttttttctgtcacttggggctgggatgatttcgaggaagtatttaatacgtggcagcgctgggctccatttacagacaaccggcttacctcatcaattcagttttggcctaaggaagtaaaccgcatagaagcgctcggtcaatttaccgggacaaaggatgagctgaaagaactgctggctccgttaatgaaagcgggaaaaccagcaagcggcatggtcaagacagtgccatttattaaagcggcagccttttttaacagcccgggaggcaatcagccgcaaaagatgaagcggtcaggatcctttattgaaaaaccattatcaacacgcgcaatttccactttaaagcgctatttagagcacgctccgaacgaaaacgccagtgtctggcagcagtctctcggcggggcggccggacggatcgctccggaccaaacggcattctactatcgcaacgcaatcattgcccaagaatatattacaacttggacatctgctgaagaagaaagacaaaatgtccgctggatcgaaggactgagaacgtccctatcaagagaaacgatgggagattacgtgaattggcctgatagagaaatcagaaactggctgcaaacgtattacggagaaaatgttcaccgcctccgtcaagtcaaaacgaaatacgatccggaaaatatattccgctttgaacagagcatttcgccgcttcgccgttcaccgtttttctaaaaaagatgaagatgggcaaactccatcctcatcttttcttttattgatataagcggcttcccttctctgcaaactcttttgctttttctttcagtccttcgttgacggcctcgtcttcagtaagtccgttttccttcgcataatcacgaatatcctgagaaattctcatactgcagaacttcggaccgcacatcgaacagaagtgagccgtttttgcgccttcagccggcagcgtttcatcatgatattccattgctctttcaggatcaagcgacaaatgaaattgatcacgccaccggaattcaaaccgcgccttagacagagcatcgtcacggatctgtgcacccggatgccctttagcaaggtctgcggcatgtgccgcgattttgtacgtgatgacaccttctcttacatcatcacgattcggcagccccaaatgctccttcggcgtgacatagcaaagcatcgccgtcccgtaccagccgatcatcgccgcgccgattgctgaagtaatgtggtcataacccggagcgatatccgtcgttaatggcccgagcgtgtaaaaaggcgcctctttacaaatttccagctgcttgtccatgttttccttaattttatgcatcggcacatgacccggtccttcgatcatcacttgcacatcgtgcttccacgcaatctccgtcaattctccgagagtctccaattccgcaaactgcgcttcatcattggcatccgcaatcgaaccggggcgaagcccgtcaccaagagaaaaagcgatatcataggtcttcatgatttcacaaatttcttcaaaatgcgtgtacagaaagctttcctgatgatgagccaggcaccattgcgccataatcgcccccccgcgggatacgattcccgtcgtgcgtttagccgttaacgggacgtaacgaagcagtacgccggcatggatggtgaaataatccacgccctgctccgcctgctcaatcaatgtgtcacgataaatgtcccacgttaaatcctcggcaatgccatttactttttcaagcgcctgataaatcggcaccgtccccacaggcacgggacagttgcggataatccattcacgcgtcgtatgaatgtcttttcccgtggataagtccatcatcgtatcggcgccccagcgaatcgcccacgtcattttttcgacttcttcttcgatagaagatgtaacagccgagttgccgatattggcattaattttcacatgaaaattccggccgataatcatcggctcgctttccgggtggttgacgttagaaggaataatcgcccggccgctggctacctcgtctctgacaaattcgggagacacatgctcacgtattgcgataaactccatttcaggcgtaatgatgccttttctcgcataatgcaattgtgttacatttttccccggcttggcccgaagcggtttccgctgtaggccggggtattcagcggcacggccctcttttttataaccgttgtcttcaggtctcacggtccggccgttatattcttctacatctccgcgcccggtaatccactttgtgcggagcgcccccagcccttcatgaatatcaatctgtacatctgggtctgtatacggcccgctcgtatcataaacacggaccggcgcattctcctcttccccgaatgcccccgtagtcgcactcaggctgatttcccgcatcggcactcgtatatcgggcgaagaaccttctgcataaacctttttactgccggaaaaactcgacataatggaaatgttcgcttgctgtactgattgattttgcatacaaatctctcctttatcatttgaataacagaaccaagttcagcaccagcacaaaaaaaccgggttcaaagaagaacccggttttgcagtcagaaagaaactattattgttttcatcaacaataataaaacctttacttccccacgctggtacgaaccagatcaggtccaaagggttaagaagccgccgcttctctctcagcccgctcagacgggcacccccagtaactattgatttcgctctcatcgtaacataagttgtgtacaaaaaaaagcatattatcaaaattcagataacggtacggtcataagctctgtttcccgaacgcctttttcggtattaaaaacccgataaccctttgcggtttccctggaagagacagcccggaacagctgaccgtctttataatgaagcgcagcgccgtcatcagcggcatagccctccctgagtttcttttctgaaatcagacggtgatacaccggccggcgctccgcttctccgtcatagtgcggacaaaagcttcccggcaaaaatcctaaagctcttaactctctcaaatctccagccgaatccgtcaatccttcttcataccagcaaatcgccccggcgctgagacccgccaacatgatgccgttttcccaagcctcacgaagaataaggtcaagcccccactctttccataagacaagcatattgcgcgtatttccgccgccgacatatataatatctttcttcatgagaaaggatctgagatcagaacccggcggtttaaacagcgacaagtgatccggctcacaccgcagcttttgaaaggcctgataaaacctgccgatataattctccgaatctccgcttgccgtcggcaaaaaacaaattttcggctttgaccgcgccgactgctctaaaatatactgatccagcacaagataatccggctccatggaaaagcccccgccgcccattgcaataatctgcttcaatgtcatcacctcttttttcctctagtataacagctcataaaaaggcgttatccccatttcggataccgcctttaaaaagtatttgttatctaaaaaatgaaaacgcaccgtataacacaacggagatccccgcggcgataagcgccggaacaagcttcgaacgggcatacttcacaacatcgatccccaacaccgtacaggttgtcaccgtattatcactgagaggagaagcaaacgctccaaatgttccgctcgcaaacacggccccgatcgctaataataagctggtatgtgactgaaccgccagcgttacgccgagcggcattaaaagcccccaagtcccccaagatgacccgataaaataggatataacagcccccagtataaaaagagacggcgcaataaacatatgagggatccatgacgttaaatgagaagtaacatattccgagaatcccagatcttcagatactgctgttacggcccaaatcagcgataacataataataacgttgaccaattcgtttccgcccttaataaaatgggtaacaagctcgcctgcatgaaaacgctgaaacataaaaagagcaaatgctgcaataaccgctgccaataatgcggttaacatgacgccaagcatatcgcttttgataaaagcattcaaaaacccttgtgcttttgaatggccgtcccaccagctgagaaagagtgttaatagcaaaaacagcccgatcggaatgattaaattccaaggccgaatcggtgtttccttaatataagcacggtgcgccgaatccagctcctcctgctggtcagcatgctcattactttcgaacattcccgtatgttcaccgtgaatatctgagatcgtccctgtttccatgttaaatgaacctgagctttttgaaagcaacacaccgctgttccgcggaatcggttccgtatttttgttatgtttgcgagcagaagtttgtccgctcttttctgttttttctaagctttcgcccgctttttgtttcttaaaaaagcagtaataaattccgactactataatcacaatggagaaaaaattgaagggaatacttttcacatacaccgtgtaagccggctgatctattcctgacgttttaagggcctgtccgataatggaaaccatgtagccgacaaatgccgttgctatcggaatcaaggcaatgacagggtttgccgtaaactcaatggcatacgcaattttctgtttcgacaggtccagacgcttgcttaaagctttcatgatcggtgcaattgtgacgatgcgaaagtccggttcactgaacgtgccaaatgtcgacagccatgcaagcagcatcgcaccttttttggttttaacttttttactgatcaaatggacgaatccttttatcccgccggtcagctttataatccctacaaggccggcaaatgaatatagaaacacaatgattctaatattattggtgacgacaatgttgctgattacatattgaaccatatgttcaatcccgccaagcaagctgggatgcaaaagatagcttccgaccagcaaaccgacaaacagaccggactgcacttgctttgtaatgattgaaatgggaatgaccagaataaatgggataagacaagtccaagtcccttccataaaaaacacctctttcaaagaacttcttgttagtatctttgaaaaaagcgtatttatacaatctgcacgcgtatcatgttttcacaagccttggaggatattttcacacaacaaaaaaggcttctacatattgtagaagcctttgtataccggtggccggggtcgaaccggcactccagaaggaacacgattttgagtcgtgcgcgtctgccaattccgccacaccggcatgtaattcgtcgtgttcaaccgacgtatataaatataacatgtatttcataaaacgtcaacggttttagcaaagttttttaaatggtaatgcagtatatacgatacaagcaagaaacttatattgatagtcattacgtttttattatataaaaaaagtgatctgcaatatgcaaatcactctcatatatgttttataatgtgaaaactgatgaccaatttaacatagttcgttcaaagttaaattggtgccgagggccggacttgaaccggcacggtagtcacctaccgcaggattttaagtcctgtgtgtctgccaattccaccaccccggcaatagaaaggcgacacccggattcgaaccggggataaaggttttgcagacctctgccttaccacttggctatgccgccgtaatttggagcggaagacgggattcgaacccgcgacccccaccttggcaaggtgatgttctaccactgaactacttccgcaacatgtaaaagaacttaatacatcttatgctgttgtttttaaaaaaatgcaactgggctagctggattcgaaccaacgcatgacggagtcaaagtccgttgccttaccgcttggctatagcccaatgataatatggggcgattgatgggaatcgaacccacgagtgccagagccacaatctggtgcgttaaccacttcgccacaaccgccataatctgaagatgaataaataatatagtggcaggggcagtaggaatcgaacccacaccggaggttttggagacctctgttctaccgttaaactatgcccctatttataaaatggtggaggggggcagattcgaactgccgaaccctgagggagcggatttacagtccgccgcgtttagccacttcgctacccctccatcatttagagtgccggccagaggacttgaacccccaacctactgattacaagtcagttgctctaccaattgagctagaccggcaaatggtggctcgggacggaatcgaaccgccgacacacggattttcagtccgttgctctaccaactgagctaccgagcctttttataaatggcggtccggacgggactcgaacccgcgacctcctgcgtgacaggcaggcattctaaccaactgaactaccggaccatttttttggttgcgggggcaggatttgaacctgcgaccttcgggttatgagcccgacgagctaccgaactgctccaccccgcgatgataatggtggaggatgacgggctcgaaccgccgaccctctgcttgtaaggcagatgctctcccagctgagctaatcctccatcatataagtgacccgtacgggattcgaacccgtgttaccgccgtgaaagggcggtgtcttaaccgcttgaccaacgggccctggtattttttcgtttgttatgtattgataattagtggcggagagcaagggattcgaacccttgagacggggttaccgcctacacgatttccaatcgtgctccttcggccactcggacagctctccataaatggctccgcaggtaggattcgaacctacgaccgatcggttaacagccgatagctctaccactgagctactgcggaatgaagtctgcctggcgatgtcctactctcacagggggaaacccccgactaccatcggcgctgaagagcttaacttccgtgttcggcatgggaacgggtgtgacctcttcgccatcatcaccagacattttagtgacatgtattattatactatgtatttcagaaaaagcaagagtttttttaaaaaattctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgtagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcatttcaacctcatctcgaggcgactttttcagtataacatttcagcgagttgctgtcaaatgtttttttgtttttatttctccgccgctgtgagctttttgttgaagcgcatcagcgacgtttaataatataccatgcctatgattcagcgtcaacactttttttgaaagaatatcctcgatgatatacttcctgccctttggtctctatttgagatacttcaacaaagcctttttccgtcaggtaatcaagcatgacaccaagatcttgggtgaagtgcaccagttcagggtgctgaagcaattctccaaactgccacatttctttttctttcatcacttgaaaaaggtgcgcagaaccgatttcagcttttgaatggatgagaaaatcatttgctaagaataataattcgagtcttttctccaaactttcgtgactctcgacaagttcggaatatagcttatatacctgcggctcaatgtgacggacctggttccagactgtcgtttcgggataaaacccccggtcaatcacttctatgcgggccaagtggtgaagagcatgcactaccgcataatatgcatccagaaaatgatcagcttcaaaaaacgcttttccttctacaaatcttctgatcagcttgccgtattccattccgatctttaatttccgctcggcgaaaggaaaagtgctgagccggtcattgagttcagatatatattcattgcggtcaaacagcactttgccgttgatgatccaatctatgactcttctattggtcccaagcagaatccattcctgaagcagagcatccgttacaatatgtaaagaagcggttttttgttcgaattcataatgctttataaaaagaggttcatcagcctgtttgacaatgacaagcatgaccgcatcaaagttatccgtgatggatgatgctttactccttctctcaatcataaggacggccagcgtatcgggatgacttgctctttcttggtaaattggacggagaagattgtccattacgattcctccaatgcgattgtttcactagctattgtttctacatttctatgataaaacatgaaagtccttttttctaaacacattgcactattataacaaatttcctttcaggttccatatttattcttcccttttcttacgaaaacatgaagaatatgccatctgttttgtgctatagttaaacgagagggggatggacatggcgaaatactcaagcaaaattaataagatcagaacgtttgcgttaagtttggttttcgttgggtttatcattatgtacatcgggctgttctttaagcagtctgttttgcttgccagcttgtttatgattctcggcctgctgtcgatcgggctcagcaccgccgtttatttttggatcggcatgctgtccacaaaagcggtccgggtgatgtgccccgcttgcgagaaagaaacgaagattctgggcagagtggatatgtgcatgcattgcagagagccgcttacattggataaaggattggaaggcaaagcgttcgatgagtcttataacagaaaaaacagtgtaaaataaacgaagctgaccgtatcaaagcggtcagcttcgtttagtggttttcttttttggaacattcttggcagacgccgtaaatctccaaacggtggtggcttaccttaaaccccgtgacgtgagccgcaagctgttccacttcgtcaagcccgggataatggaagtctacgatttttccgcagctttcacaaatggcgtgataatggtcagaggtgacaaagtcaaatctgctggacgcatctccgtacgtcagttcctttacaagccccgcttcccggaatacacgcaaattgttatacactgtcgcaacactcatattagggaatttcccttccaaggctttatatatatcgtccgctgtcggatgtgccatagaatccacgagatattccagaatggcatgacgttgaggagtaatccggactcccgtatccttcaacgtgtctaaggcttcttttaattcatgtgcagccatccgtcatgcacctctcttctaaaaaagattcttactttataatgtttataattagtgtacatctttttccggtctcctgtcaaatgtaatctgaagaaaaccccgtgagttcagcatttgtccattaattagacgcaatttgttccaattctcgaagcgcctcggcaacgtgatctttcacttttacctttctccactccttcacaagacggccttctttatctaacaaaaaagtggatcgctcgatacccatatattctttcccaaaattctttttcagcttccacacatcaaaagcttccgccaatttgtgctcatcatcaacgaggagctggaaaggaagatcgtgtttttgcttaaatttttcatgtttatcacggctgtcagggcttactccgataataaccgcatcaagtcccgcgaaactttcgtgctgatcacggaaatcacatgcttccgtcgtgcatccgggtgtcatgtctttcggataaaaatagagaacgacgtacttccctttaaaatccgtcaatgctacttcttccccgctgtcattcactaatttcatatccggtgctgtttgtccgatttcaatcgtcatttcttatacctccgggttttttattaagcgtatccaattcacgttaagattacaaccgttatccttccgctcttttctggaagcatgaaccgttgtgctcgcaatgaagcatgctacaatagaacatgatgtaaggagatattaggagggtcattttttgtatacaaaatcagttgaacttcataaggaagcgttagagcatatcgtcggaggcgtgaacagcccgtccagatcctataaagcggtaggcggcggttcacccgttgcgatggaaaaagcgaacggcgcttatttctgggatgtagacgggaatcagtatatcgattatttagcggcttacggcccgattattaccggacatgcccatccgcatattactgaagcgattaaaacagcggctgaaaacggcgtgctgtacgggacgccgaccaaacatgaggtcactttcgccaaaatgctgaaggaggccattccttcacttgataaagtacgattcgtaaactcaggcactgaagcggtaatgacaacgatccgggttgcacgcgcttatacaggccggacaaaaatcattaaattcgccggctgctatcacggccattctgatctcgtacttgtcgctgcgggttccggtccgtctacgctcggcactcctgattccgccggcgtgccgaaaagcatcgccaatgaggtgattaccgttcctttcaatgatattgaaagctacaaagccgcgctggataagtggggttcagaaattgcagcggttctcgtcgagccgatcgtcggcaacttcggcatcgttgaacctgaagaaggatttttagaacaggtaaatgaattgacccataaagcgggcgcgctcgtcatttatgatgaagtgatcacggcgttccgttttatgtacggaggcgcgcaggatcttcttcaagtgaagcctgatttaacggcgctcggtaaaattatcgggggcggcttgccgatcggcgcttacggaggcaaaaaagagatcatggagcaggttgctccgctcggcccggcatatcaagccggcacaatggccggaaacccggcatctatcctatcaggcatcgcctgcctggaagtgctgaaggaagaaggcgtttatgagcggcttgatgagctcggcgccagacttgagcacggcattctcgcccatgcggagacacacggcattaccatcaccgtcaaccgtttaaaaggcgcgctcacggtttacttcactgatgaaaagatcgtcaattacgagcaggcggaaaatacggacggagaagcattcgccaagttcttcaagctgatgcttgagcgcggcatcaatctcgctccatcgaagtatgaagcttggtttatcacaaccgcacatactgaagaggatatcgacgccactttacaagccgttgaagatgcgttcagacatatgaaaaaataactgctgaaacaagcgggagcccggggcttccgctttttctttttgtccgatttgtgagataatggttttttcaaaaaaagaccttgaataatcggtatgatccctgtatattactttattgtttagcaaatcagccgacagggaaatgtaagtgtcagccgttcgttcggcacataatttattagagaaaggaatgcacgcacaaaccaatgaaacttggtgcccgcatttttaaaacagggattgcgattacgctcgcgctctacttagcatcatggatcggacttccgtcgccgatctttgccgggattgcagccatatttgccatacagccctctatttacaggtcttttcttatcattattgatcaggttcaggcaaatatcatcggcgctgtcattgctacggcattcggactgattttcggaccgagtccgattatgatcggattgaccgcagtgattgtcatcacgatcatgttaaaactgaaaattgaacacaccatttcgattgcgctcgtgacggttatcgcaattttagaaacaccgggaaacagcttcctgacgttcgctctgatacgaacaagcaccgttattttaggcgtgctgtcttcttttattgtgaaccttgtgtttcttccgccgaaatacgaaacgaagctgactcatcatacggttgaatataccgatgagatcatgaaatggatcaggctgacgatgcgtcagtccacggaacactcgatattgaaagaggatattgagaagctgaaggaaaagatgatgaagcttgatcatacgtaccttctttataaagaggagagaagctactttaagaaaacgacgtatgtaaagtcgcgcaagcttgtattgttcagacaggcgattattacggcgaatcgggcgcttgatacgctgaaaaagctgcaccgctatgaaaacgaaatttatcatatgccggaggaatttcaggagacgctgacagaagaaattgattatctgcttcattggcatgaaaggattctgatgcggacggtcggcaagatcaaaccgcatgatgacgatgctgaagaaagcataagatataaacagcttttgacgaagtctttcttgaaaaatcagcagaactgcgaggatgaactgcttgattacaatatgctcagcattatggctgcggttgcggaataccgcgagcagctggagcatctcgatacattaattacgagttttcagacataccacccgaaagacagcgaattagaaacagacgatgatgagtaacccggtgctctagataaccgggtttttttgcattaaaaaaaacgtatgccgcccattcggacggcatacgtttttgtatcagttcaaattctgaatcgtaaataagtgtctgtactggccgccttgggccattaattcctcgtgcgtgccggtttcgacgacagcgccgttttccatgacgacaattttatccgcgtgcgtaatcgtggacagcctgtgggcgacgataaatgtcgtccggtttttcgcaagcttttccatcgcttcctgaatgtagtgttcactttccagatcaagagccgatgtcgcttcatccaagattaacagcggcggattttttaagaatacacgcgcgatggaaatccgctgtttctgcccgcctgacaatttgacgccccgttcgccgactttggtttcatagccttcggggaaattcataataaattcatgggcatttgccgctttcgcagccgcaaccacctcatccagagacgctcccggtttaccgatggcgatattttcacgaatcgtctcactgaacagaaacgtatcctgaagcaccattccgacttgattgcggaggcttctcgcttcataatcgcgaatatctgtgccgtcaatcagcaggctgccgccggatacatcataaaaacgcggtatgaggctgacaagcgtcgatttaccgccgccgctcatcccgacgagcgcgacggtttccccttttgtcacctttaaggaaacgtcctgcaaaatcgtttcttttccttcctcataacggaacgagacatttcggaattcaacttcgcccttaatgccgtcagcttttactgcattcggtttatcagtcagttcatacggctcgtcgataaattcaaatatgcggtccattgaagcgatcgactgggtcagcgtcgtcgatgagttgatcaatcttctgaccggattgtacattctgtcaatatagccgacgaacgcaaccatcgtccctaccgtcagcggaccgtttatgacaaaataacccgcaaacgcgataacgagcagcggcgccaaatccgtaatggtattcacgactgcaaacgtttttgcgttccaattcgtatgacggatcgctctgtccagaaaatgtccgtttttttcatcaaaattggcttgttcataatcttcaatggcaaaacttctgatgacgggcatcccctgaactcgttcgtgcaaatgtccctgaacttgggcgagtgcctgagaacgctcccgtgtcagttttcggagacggccgtaaaagtatttcactgaaattccgtataacggaaacaaaatgacagatatcaatgtcagcttgacatcgagtgtaaacataatgcagatgacgatcagcaccgtcatcatatcaagccagatattcatcagtcccgttatgacaaagtcttttgtctgttcgacatcatttatcacccgggaaatgacttcgcccgttctcgtgttggcataaaacctcaggctcaatttttgaatatgatcaaacaatactcccctgatatcatagagcacccggctgcccgtccattgcgcgaagtattgccgatagtactctaccgggggacgcagaattaaaaacagcacgaacatgatgcccattatcgtgaatagcgatgatgttttagcgcttgccgttccgctcccttgaataatgtcatcgaccacgtattttaacagaagcgggagagccagcgggatggagaattttatgatgccgattaacactgtgattaaaatttgttttttataaggttttacaaattgcatatagcgtctgattacgcccacactttatccccctctctctttaaggcgtgtgagcccatgtgaaaaacctgttgacaccccaacaggttttttattgtattctttattttgtatagcgcagataccgttcataccacatatcaacaaattccggagcaaacggtcctttccgctgatgaatccagtgcagcagcgtattcagatactccttcagaatgctgtcgatctctttagggtaattcattgatttgcggtggtcatcgtattcatcctcgtcaagaatgttatacgtcatatccggaaacaccttgacatccaaatcgtaatcaatatatttgatggcctctccgtcataagcgaacggcgagctgatgttgcaataatagtgtaccccgtcatctctcagcattccgatgacgttaaaccactgacgggcatgaaagtagcagatcgccggttctctcgtcacccacgtccgtccgtcggattccgtcaccattgtccggtcgttggctccgatgatacacaattccgtactttttaaaatcgtcgtttcattccaaattcgatgaagcagcccgttatgcttatagctgtgaatttgaatggtttctccttccttgggatatcccatatttctcccctactttctgtaaagccctgcagtcaatgcagccgcaattgctttccgacaagtcttttcactattataacgttacgaattaaaaaatgaaaataaaagaaccactccgcttccggaatggcacattcatttctgcacataggaagacggcttttccgtgctgcgataagactggatgacttgctctgtctgcctttggaataactcctgtatgccggccaggtcttttcgctttgtcgcaatttcgtcctgtacattgtccagctttgcatctctttccagactgatgagttccgcttccacctgccggcagcggtcaagttctgactgcaactcgagaagctgatccatgattttcatctgttcacttacaagcttttcaaactctgacatcgggttcctccttaggcttttaggttgatactccttaccatttcgattttacgccggaaaaccctttgactcattctgtagaggaatcacaagttttgtcgttttggcaacagaaaaaagcacttccatccgaagatgaagtgctttttcgtttcagtgattagctgttttgctgtttgttttgttcagcagattggttttgctttctaacctgctgcgcatcagtttcactgccgaattcagtgccgtattgaccctgaccggaagctgattgctggttttgtcttttcacctgctgaacgtctgttttgctgtattttgagtttgccattgttatcacctccacgcactttagaatgcgcaggagacgataaggctattcatctttttttaaaacttatacgagcagagaacgtccgccgtcaataatgatggtctggccgcggatcatgtccgcttttgaagaaactaaaaactccaccgtatcgatcatatctttaatttcgaccattctgccggccggcgtattttggcgggcatcttccagcagttcatctctgttagggaaatgcttcagcgcgtccgtatcaatcgctccgcctgacaccgcgtttacgatgatatttttcgaagacagctcaaccgccagataacgggttaacgattctaaagcggcttttgagactccgaccgtcgtatagttttcaagatagcggatgctgccgagcgagctgatgctgacgatgtggccgcctccgtttttctccatcatctttgccgcttcctgggcgcagaaaagcaatgctttcgcattgatattcatcgtccagtcccagtgtgtttcttcgagttccatgaccggtctcagcacgcctgaagccgcattattgacgaacacgtccagtctgccgaatgtttcgtcaatctggcggaacatgtctttgatttttgccggctggccgacattggctttaatgacgagcgttttaacgccgagtttttcaatttcttcggcggtttctaatgccgcttttttactgcgggcgtaattgatgacgatgttgtatcctttttccgcgagtctgatggcggctgctttcccgacgcctcggctgcttcccgtgatcagtgcgcatttattttgttccatttttcctcagctccttgctgtgtatagttcttttcattcaacaaacaataaaagcaatatgtgttgaaaggggtcttttatatgtatgtcggacgtgatatgggcgaattggccatgatgcccaaaaaagattggagagattcagagctcgcctatttccatcatgccttccagcaaattatgccgtatttaaacgaagaaggccagtccaaataccgggaactgattcaggaaatcgaagcccgcggcggactgaaacggaatgaagcggattacggccacggcactcgcgtcagctatgactgacgctttttacaggcggccgctttcttccgccattttccatatcttttgatgggaaacgggaaatgcgtattcctcgagctcctcttttgtgacccgtatgaattccgttgtatccgacacttgttttactttaccgaaaaagaccgaaatattccagacgagatgggtgaaaacatgttctacgataccttccagctccccgatttcagcggttgttcccatctctttttctaaataggcttcaagctgctctctttcggttttgattcctttctgggtttcggtattcggaaactcccacaagttggcgagcaagccttttggcggccgtttatgaatatagacatcgtcttgatcgtctgtcagcacaacggctgccattgtttttattccgggctttttctttttgcttttaacgggcagctcccgctctgtcccttccgcaaatgccgagcagtgcttttgtacggggcaaagcaggcaggacggcgatttcggggtgcagatgatcgcgccgagctccattaaaccctgattgaattcagatggtttttcatgagaaatgaaagcggataccgcctgttcgaaaatggttctggttttaggttttgcgatatcgtcccatatggaaagaattctcgacatgacacgcatcacattgccgtctacggcggggatcggtttgttgtatgcgatgctgagcacggcgccttttgtataagggccgacgcctttcagtccgccaaattccttttcctcggcagggacgactcccccgtaccgctcatgcacttcttttacggcactttgcagatttcttacacgggagtaataacccagcccttcccaggctttgagcactttttcctcatcggcttcagcgagcgccgaaacggtcggaaattgctcaacaaaccgccggaaataagggataacggtttctacgcgcgtctgctgcagcatcacctctgacacccacacccgatacgggtcctgattttctctccacggcagaattctctgttctctttcgaaccatgtaattaagtcctcgcgaaatttgtctatatctttttgtttcattttttcttcaagtgcgttcatatcttctcctcagatgtttcgggttccgcttttcttgacaccgtattttggtgtaaacttagggcacgttacgataatatgttacattaaatagtgataaagaaaaagcggaaacatatgagaacggcggataaacgccatgattgggcaaacagaaaatggggaatatcttataatgcgaaatatgcgggcgactgattgttaacgcctgctaggaggtcaacaatggatactggcactcacgttgtcatgggtatcgcgcttggcggaatcgcaactcttgatcctgccgtcggcatgcacacccccatgtctcaggcagttatgatcgccgctcttgccggctctcaggcacctgatattgataccatattgaagctgaaaaataatgccgtttatattcgaaatcatagagggttcacgcactccattcccgccgttttattttggtccgttctgattccgggtattttgtttatgttttatccggaagcgaactttttgcacctgtggctgtggacgcttctcgctgtcgttttgcatgtgtttgttgacatttttaacgcgtacggcacgcaggccatccgcccgttttcgagaaaatggatcgctctcggtttaatcaatacctttgatccgtttattttcgtcagccatttggccgcgattgccgtgtggtatatcggaggtcatccgggcgtgacatttctgatgctttatatcatcctcacaggatattacgccgtccggtttttgatgcagctgcggataaagcgaaggctgcgcgaaatgattgaagaggagattgaaaccatcattatttcgccgacgatgaaattcaggcagtggcgtatcgccgtgacgacggcgcatgccttttatgtcggcagaagccttgacggccatgtcgtgatattggatacattcaaccgcgtgcccgttcctgaaaccgatgtaatgaaggccgcaaaacaggacgaaaatattgcagcctttctttcattttcccccgtttacaggtgggaggtcgatacctttaaagatcattatgaggtgcgttttattgatttacgctaccggagcaaaggccactatccttttgtcgccatcgtccacctcagtcatgatttagagcttctctcttcttacacgggctggattttcagcgaggaaaaattgcagaaaaaattaaaactcggctctgtttaagagccgggctttttttgtcttctcacatatatagccgcaaacacgaggctgatcaccgatagagcggccgcgggtttaaaaaacggcgggtaatacgttaattgaatatcgttttttcctttttgcgctttaaatccgatgaaggaataatccgcttttttaatctgctctttcctgccgtttatcttcagctcccagcctttttcatatggaatcggaagcatgatatacggcgcgcgggttttgttatcatacgagatatgaagcgtatttccgcgccagctgagatcggcccgcagttctttttccgcttttcggtatgcgcttttcagcgtatcgtattgttcttcataaagcgccagtctgtcaagctgatacgatcctttcggcagacggatttggatgttttttgttttcggcactctgacagtaagatcgttgacacctgttttgtaaatggattgattcgattttctcgttgtcgtgtaatcgttcacttttaatgtaaagccctggtccttcgctttattcttcaaataaaagctgacgtaataatcgccgccgtccatcttagcggcttgcggcgtaatgatcaggccgccgccgtcttcgtttaccgtcaggatgccgttatgataatcgccatgttcggccgctacctctgcatggcggatcatatttttcgcctcagtcgcttttttcgtgttggttgtgcttgattccatgacgatcccgtcaagcattgcccgttccctggcaagggcgggcgcttttttcaggccgccctcgttatacacgcgatcggctgtccgtacgaacggaagcatatattgattttgataaaccgcataatgggttgattccatgatttttttgaacccgtacggcacgccggcctcgtttgttttttccgtcatataatattttccgtaaagcaggctgtataaattagccctgtttcctaatgtcgcatagcggctgacgctttctctgcccatgtcaatctggaggtcgtgccagtaaaaggacagcagattgcggttcagtatacttgagtatacgctgaatccgttgaacccgtatatgatcggggtgttattgaaaacaccgttcatccaatctaaacgggcaaacggatcagggtctttttctttcaggcgctgaatgagctctgattgctctttgcctttatagtcagcacccgtcataaatgtatgcgataccgtataaatcttcccgccttctgataaagcatatttttcatatgtattagccgtaagcaccgccgtaagcaaaatgacggcatagacggcgggcaccgcgcctttcagtcttgtctttgctgcaaagaaagcggctatgctcagcaccagaagaaggatgacgggcaggttggcgtgatcagaaatatccagactgtaccgcctcacctggctccaatagagcagaacgacgagtacggcggacatcagcatactcttcatgctgatgtctgaaagcttagaaagcccggctgaaaccgttccggcaatcgtgaagcacaggacgtattcaaacctgttctgcggagctgaaaaaccgttaaaggcacttgccgcgaacggactgaagtgaaacagaatatacagcagactgattcccgcaaacagccggaacaagcggtttttgtataaagtaaatgtaaatagaaaaagcaaaaaagccgccggcaggatgattatccggctagaaaataaaatgttgtcggaaaaatcaagccatgcaatatgctctgaatacggaggccgcagattatgaaggtatccgtatacgacaggaataaaggaaactgcgcttatgccgaacccgagaaggcccgacagaataaatatcctgcattgagtgagcctttccgcctcattgccttcaagggggatcacccacctgaataagatataaacgccgatgaaaatcagattaatatacgcaaaataaaagttgttgatcaatgtcagcgcacaggcgaagataaaccacgccggctttttttcccggatgattttttccgcgcccaacacaagcaacggcagccacaccatactgtcagtgaaaaagtcccaatatacctcatgccggaagtagataatcgagaccccgtacaacacggcgcccgcaaaagcaggcaccgtccgtttgacgaaataacggaacacacacgccgctgtgaatatgatcaaactctgcttggcgatgctgataaaaacggaggcctgcgcccaaaacagcgcatcagcctcacccgtcagctgaataagctgcaaaaagcggacagcggcggagataaacaggaatagaaaagaagtagagaaataatagccgagctgactgtacacgcccccgcccagtccgaacgaatagctgtaaaacagcctgccgttcatatattgatcaaacagcagctttttgaagaccgccatttgggcgatcccgtctccagaccccgtcatatagcggccttgcgaccactcttttaagaaaaaaatatgagcggctgccgcagccagcacacaggctgccggcaagatccatttgttttttttcatacaacgtccccagaccctgcgcacagcggcgcctgtttaatggttccacttgcgcttttttgtataattcgtttcattttgttctccgtacgttatattcgcttctttaattaaatagtgcgggcgtttttttgtttcatagtaaatccggccgatgtattctccgatgatgccgagactcaaaagctggatgccccctaaaaacagcacggcggaaataatggtgaagtatccgggtacggacacgccgtgtgtcagaatatgaacaaaggtcgttacaatataaaccatcgacaaaagcaatatcagaataccggtgaaaaagcataccctaaggggcttgttgttgaaggagacgacaccgtccattccgtagttgaacagattgctgaatgaccatttggacgtgccgttcttcctttcgacattttcataaaatacgattttctggtcaaacccgatccagcagaacagccctttcgagaaacggtttccttcactcagcttcaaaagggcatcaacggcctgccggctcagcaggcggaaatctccgaccccgtcacgcaggtccacttcgacggctttgttgataaatttataatacagggaagaaagcacggaacgcacggggctgtccccttttcggttgcgctgcgcgatgacttggtcatacccttcttcatagccttgaatgaagtctttcagcagatgggtcggatgctgcagatcggcgtccatcacgattaccgcttcgccctgcacgtgttcaaatcctgccaaaatggccgcttctttcccgaagttgcgggaaaaagatatgtatttgacgcgatggtttctggcggccagttctttaatctgctgaagggtgtcatccgcgcttccgtcattgatgtagaaaatttcatagtcataatgaatcgtctgaaactctttttttaaagattcatggatgagcttgacgttgttcccttcattgtaagacggaataataattgagattaacctttgtttcatgaaggcaccttctttgtattattctttttttaggacggccttaaaggaattgtccgcaaaacttcagtaaggcttttcctttttttaatgacgtttaaaccctttttttgttacagggaaagaaaattttttctgcatatgatttatattttgtcatgtttttcggcagatatgagaaaaaaaagaaaaagtctgtacgcgggacagactttattgctgaaggtattcatgaatcaaatggctgacaatgcgcggtttttcgtgaatgacccaatgtgaggcatcatctatgaagattaagtcgccgtttggaatcatccgttttgtttccttggcgagctttttgctcagcgctcggtcattgacgccccatattaatcggtacggaacgggcattttaagcggaacggcagggcctaaaccgccggctctgatcgcccggtaccagttcagcatcgccgtgagcgctccttttctgccccaagcttctttgtagctgtcgacatcttcccgtgaaaaaagcgccgggcgttcagataagccgatcgcgtgatccaatacgcggtaatcgtcttcagacaatctccgttccggcttttccggaagctgaaagaacgcgatataagagcttttcttccactgcggcgggtagaacggtgtgaccttccgcataaccgccgggtgcgggatattgaccgtgatcaatttttcaacgtattgcggccgcgtggatgccaaatgccaggccacggctcctccccaatcgtggccgatgacgacggctttgtcatctgtaaaatgagtgatcagcccgataatgtcgtctctgagcgtatcaatggtatagttttcaatgccctccggtttgtcactgagattatagccgcgctgatcaggcacgacaacatggtatccggcatccgccagcggtttgatctggctcttccagccgtaccagaattccggaaacccgtgcagcagcaccgccaaaggaccgtctttcggaccggttgaagccgtgtgcagcgtcactccgtttgtttcgatcatgtgaaacgtaatgtcattcatcgattctcctccccgtttgtttcaatcttctttctgttaagacgatgatcagtacgctgatcgcaatcaataatacggcctgaacgatcagggcgaacggctgagtcagccggataagcaggctgcccgcaaatccagctgccgccgatataaggccgaacaaaatcatgagaagcgcactgaatcgattgccttctttccactgcgactcatccgccatagagcgcttcgtccgatatccgtacaggctgttgatcgacttcggcggaaaaaatgtgactaaaatgccggccgcagccatcagaaggccgccgatcaccattatcatatccctcactctccttttcatcttttacgaaaggaaaggcggaaggtttcagaaaaaaagcaggctcattcgcctgcctgaatctttatttttgagttaagtcggccgttttcacataacctgctttcccgccgtatgtgacgtacgcccatttacggtcaaaccctccgtcatggctgaacccccagccgagcacattgacggtttcacccgctttaacggacccttttttgccggtttccaaagtcggcgtataaaaagcggtttgtttcgcggtcaccgccttcaccggctgcttcatcagaaaatgcgtggaaatataggctttgtgccctttgtagtcaatctcagcccaatctgctccttgaagccgtttaacctttacggaatcctctgaacgaagcgtgccgataatcgacccttgtttatttggttctttgcggacgttaagttctcctgctttcacgatatatgtatctgctgcggtgtctatttttgtctgctgaactgctgcggcattcgctgccggatcaaaaaaaacggtgcctgcggctaaaaataagcaaagtcctgcggccggaataaatgcggttaacccctttttcatgttcattgtggttcctccccgctattttataagttattacacatttccacattccgccggtcgccaaacatgatttttctatttcttttataaaaagtaaaaaccgccggacgatatccggcgggcgaactgctatgttaatgcaggagacccctgctttgatccaaataatgagaaacgtcttcccgaacgctctggaacatatggagcttgctgccgtatgattcgatccattccttgacgacgcgttccgtcatttgctctccttgatacgggcggccggcttttgcgtaagtcgcttcgaaatctccccataaaagctcaacccaagttcgcgcttgcaaatagctgagcatgtcatttttctcaagcagcaaattcgtcagtttgtcgatatatgtattcatctctctgtctcctttccttgggaaaacctgctgcttttacgcagcttgtcacaggcatatactaactttacgtcttcagtccagaaggcgcaaccttttgatattggccgagggggaaaacaaatggtccggaacaaggcaaaaggatttcctaatcagaacaataataagtttgaaggcgaaccgcgggcaaaggatgactacgcttctaaacgggcggacggttcaattaattcgcacccgcaagaacgcatgagagcttcaggcagacgataacacacacaccgtaagagaccgggaatgacccggtcttttttttgcggaaaaaaacatccttttgcggtcataacgctaaataaattccataatatgttaaatgttaaaacgaaagccggtagacaaaaaaggaggggttttataaaatgaagacagtttcaaaacgattgctgagccttaccgcattcttactgtcagtttcattatttgctgtttcagctgaagcagcgggcagcccgcagacatctgtatcaaacagcggtgaggagtttgacgcacatcagaatcagcctgtacaaacaacacagacatcccccgcttatgaaggaacgggcctcatcaaaagacagcttgcacaaaacagcaaagctgacatcaagtcattaaagccttccagtattattgggacagacgaacgaatcagaatttctcctacaacatcatttccatatcgagcgacagcacagctgaccgttacatacagcggcagcacaagcacctacggatgcaccggtttttttgtcaatgccgacacgatcgttacggcgggacattgcgtgtatgaccagaaaaacggctgggcatcaaaaattacggcagctcccggccgcaacggatcatcgtacccgtacggctcttattcaggcaagacattctacagtgtcaaagggtggacagaaaacggtgacacaaactacgactacggcgcaatcaaagtaaacgggtcgcccgggaatactgtcggctggtacggctaccggacgaccaacagttccagtccggccgggctttcctcaaccgtgacaggatatccgtgcgacaaagtgtccggttccatgtggtcagacagcaagccgattcgttctgccgagacatataaactcacttatacgacagatacgttcggctgccagagcggatcgcccgtttaccgcaattacagcgacaccggccagaccgccattgccattcatacaaacggcgggtcgtcttacaatctgggaacaagggtgacaaacagtgtattcgacaacattcaatattggtcaaatcaataaagcttttgttttctttctcgcggcggccgttttatgcggatgcggcaaagcggatgattccgccgccaaaaaagcattgcccgttacgctccatgttgaggatgcagaaggctcaccggcggccggtgtgacggtcaccgtgatgaaagcggcggagtcagatcatcagccgaatatagaccgcggagagataataggcaagactgatcaccacggcgagattgcatggaaaagcggcgcgaaaggaacctatgccgtcgtttttgaaaaagacggagtaccggaaacccggaatatttccttagctgagagtgataaacatacggtgatcagcattacattgaaacactgaaaaaagcttgcaggcggaatatcccctgcaagctttttgttatcctttatgcacttggtattcatagacatctttcttctcagacagatgagcgaacgtggaaagcacaaggccgagagccgtcatcagcgcaccgccggcaaacagccatgagtaagatcccgttcccccgagaatcaatccgccgatccaggcgccgagcgcgtttgccaggttaaaggcggaaacgctcaccgcagcggcgattgtcgtgccgttttctgaggaagaaataaccttggtctgcaaaagcggcggcgtgccgaacgcacatgcgccgaataaaaatgtcgctgaaaccgcggcggcgggaaaaacagcgatataagggaaaatcgccaagacgccgatcaagccgatcatcacaccgatcatcgtgcgtgtcagcagtttgagcggcactttccccgcgaagaaattccccgccactccgccgagaccgtaggcaaataatgcgcctgtgatgccgactgtgccgaaccccgctgaatctcttaaaatcggctcaataaacgtgtaagcgataaatacgcctgagtagccgagaatggtgatcgcaaaggaaaaaatcacttgcttatgcttaaagacactccattcattcatcagcatcggaatcactttcggtttccggttcggtacgaccagcatcagtccgatcagcccgatcatgcctaaaacggaaataatgaaaaagacggcccgccagttaagggcatctcctaaataagagccgaacgggacaccgagcatcagcgccacggttaatccgccgttcatggaagccgcggcggcggaacgtttttcaggcggcaccatttcactcgcaaacaccatggcgatcgcaaaaaaagctccgtggatggatgcggataaaattctggaaatcgccagcacggcgaagtttggcgcaaagacgctcatcaggttggcaaggacgaagatgcccattaaccctagcaacaccggctttcttggcagcttaaccgcgataatggttacgatcgggcccgtcaggcagacgctcgccgcgtacgccgtaacaagcatgcccgctgaagatacatgtatatgaaagtcatcggcaatcgacgtcagaatacccatgacagcatattccgtatacccgatggaaaatgtgcaaatcattaacacaaaaatcattaatttcacagatggctgtttcattttgatattcaacgcaaatcgcctcctttttatttaaaaaacaacgaattccatcttaaaagatatcaaaaatgaattcaatcattttttactgaaagtatgaaacgaatgtgcccgaaaagaaaaagaggccggaaccggcctcttttgttattttttttcttttaaaacggaaatcggcagtgcttcttccccgtcagacggggaagatctgtgtccccaggcgaatacgccgttgatgtaatcaatgcggaaagtgtcatcagaaccttctatctgatacaccccgccgggccgaaagtcttccgggttcagcatgtaagctttggccatcgtaattttccgttcaagcacggccagttcatttacaatgcccatctgttccgcttttcgcgctttttccgtcagtcccgcaatttctgtctgtagttcatgaggcgtcatttgactgtatcgtttgtccatttcagtttactcctcttcctgcaagaattgatcaatatcgtcaatcgagaatccttttctgaataagtactgtttgaccttcattccgctttcataactgccgtcatagcggtatttcctgatcgctttttccgcatgagccttcagagcttccatctcggcttcatcatcattttcatactccgtctgttccagagcggcattgatgacgtcgaaagggaaaccttttcgctgaagctgcatctgcgcccgctgtctgatctcttttgtggacagctttttgtcttttttcaggattttgccgatatgtttcagcgcttcttgtatctgctcatcaaatgtaaacgcactgagcgtctccttgatggtatcgtcgtctattcctttcgctttcagctcgcggaacaggacgtcagggcctttgccgtttgtttttttgtgggtgctcgcataggcttcggcaaattctttgtcatttaagtagctgtaatcgtacagtttatggatgacttcagaaatgaccatgtccggtgtttcttttttcttcagatgatcccggacttctttttcagagcgcatccggtatgataaaaattctacggcgcggttaaaggcttttttcacgtcatcgccgtactggatttcaagaatgtcaagctcgtccagttctttcccttttttcaggtcaaaacgcacaagcacgtcggcgtcgacgctgaatgcatatttctcatcaagaaagatgttgaagcgctcggtatttttcttttgggtcgatatttttgtaataaacggcatcccggtctcctttcccgccccgatgttcaggcgtttttctttttggcaaatgaggtacagtatatgtatcaacgtgtaaggagagatggatatgaatatcgcgatgacaggcggcactggttttctgggccggcatctgacaggtgtgtttacccgccggggacatcatgtctatattttatcaagaaaacagagagaaaccgaacaaaaaaatgtgacatatgttcaatggctggccgaaaacgcggcgcctgagcgcgagcttccccctattgatgtatgggtgaacctcgccggcaaatccatctttgaccgctggacggacacaacgaaggaacaaatcatctcaagcagaatagaagcgacgagagaagtcagacggattatgaagcagcagccgaaaaaaccccgggctttaattcaggcaagcgccgtcggcatttacggcacaagcacagaaaaaacgttcaccgaacagtcagatacgtcaaatgaagattttctcagtcatacggctcatatgtgggaacgtgaaggccagaaaattgaagcgctcggcatccggacggtatatgccagatttggggtgatgctcggtgaaaaaggcgccctgccgctcatggttctcccttataagctgttagccggaggcaccgtcggctctggacggcaatggctgtcatgggttcatgtcgatgacgccgcggaacttattgcttttgcggcggagcatgatgacttgtccggtcccatgaatgtgacatcgccgaaccccgtagaaatgaagcaattcggaaagacgatcgcaagtgtcctgcaccgcccccattggattcccgtaccggaattttttctggagaaggccttgggagaaatgagcctgctgatcgtaaaaggccagcgcgccctgcctaagcaggcgctgacatccggttttcaatttacgtatgaagaacttgatttggctttaaaggatctcttatctgcataaaaacggaaataaaagccaatcctattggtattctgttttgaaggagggtcttcttttatggaaaagaagcgtgaaaaacatcagcagggagccaatctgaaaaaaatgcaggaagtcctttattccggtgaattcaaaaaagcggaaagagcagccaaacggaaataaactgaataaagatcgggaccgggcagatactatgtttgtttgatatcacttttttcagggggcgattgatatgggcagaaatcatactcacaaaaaccgtgataaaaacaaacaaaaacttcctcaagttccggatgctttgaaacacgaaacagacggcacgtacgaggaatattcaagcgagcttgctgattccgctgaccgcgaagcgcaggcgcggatgaaagccgctgacaacagagctaaaagcaaaacccgttaatacgaaatccccgcctctgtatagagacggggattttttttacagttcggtaaacaggctttttgccggcgtccgttctttcgccttaggctgttcatccggatagcccgtttgaatgatggcggcaaagcgctcattgtcagcaaggccgaagtcttggtgcacctgtttgtcatacataatgcggccgcttttccagaccatgccgatgccgttttcatgtgcgagaagctgaaggttttgaatcatgccgctcagcgccgcgaaatcatcgtttctcgtaaattcattttcatcttcttttaagacgaccagcaaaaatcccggaacggcgctgagattttttctcatgttccgctctttttcctcgttgaaatcatcttttatctttttgaaaaatgagacgtagctgtccgcaagctttgcttttcccgcttcgcttgctgcgtagataaaacgccatggctccgtcagtctgtggttcggtgcgtaaacggccgtttcaagcatatctaatatgacttcagaaggtacggtttccggtttaaacgaccggatggatcttctgtttctgattgtatgtgcaagactttcgttttgctgtaattgttcggttttcggcatgccgattcaccttcctatccaaatgaaaatgattatcatttataatataacggatacgaccggcatttgtaaaccgttacggaagctgaaaattgattgtttcggcatacacggccgttcccgtcatcttgatgttcatctctccgttttcctccgcgatcctgatttccacttttccgtctttcccgatttcctggccttgttcaatcgtaaggcattcggcttcggagcctccgtattgccgcatataggctgccatgacgcctgaagcggttcccgtgacgggatcttcggtcgttccggagaaaggggaagaaaaatggcgtccgtgcagatcactttccggatgaacggtttccagagaaaacggatgaacgctcgctttcggaagatcgcgcaaaatagcgggaaattgtgcgttgtccggcaccatattccgtgatgctttaagtgatctcagcggaacaatcagtgtccagatccccgttgatccgtaaacaatcggcagcccgctgtgaaaatcctcagccgtaatcccgagcgaggcggcaagcttttctttgtcgcccgtaaacggcagaaattgcgggggagcctgttcgagtgtgatgtatacccggccgtttcgttcagcggcttttgcgggaagaatgccggcttttgtttcaatttgatatgtctgatcagcctgaagccttcccttttcaattaatgcgtaaagagaggcgacggtagcatgtccgcataaattcatttcgtggccgggtgtaaaatagcggatgcgcagatcggcttctccgcttttacagagaaatgaggtttcattgtaccctgccatttcggcgatcatctgcatctcttcatctgaataatcatctccgttaaagacgattcccgcgggatttcccaaatcaggaatattggaaaacgcttcatatttaaacacggttgcctgtttcattcatcagccttcctttcaccttatgatcatgttattcagtataacagagtgaaattagaatttttagttaattcttcgaaaaaaaagacgccttttaacggcgtctttttttggtttttccgatcaggcgggtgacgagaatcatcgtgacggacagcgatctgtttttgcggtacgccaagtatttcccgcgccactccggtttgtatttttctttaaaggcccgcagcccgctgaagctgtacatataccggacgttgttgaagatgacggccgcgattctttccgaccagaaagatgtaaaagccgttcctacgtttgacaaaggcgccatgcccatattgaaggtggtatagcctttttcctgcgcccagagaaacagacggatgaaaagcgcgtccataataccgttcggcgcgcttttccgataacgcatcaagtcgacggatatctcgccttcctgatacatcggcatcaggttggcaaaagcgatgatctccccttccgcgtctttcacgtaagcaatcggcgcctgttccaaataatcccggtcgaagaaaccgagagaaaaacctttctcttttttcggtccgagccattcgtccgaaatgtctttcagcttggcgataaactcggaggaaaacggcggttccccgacatgaaatgtgtagccttcgcggtcaaatttgttgttaatcgcccgcagccccgcttttttcttacctgagagcgtaaaggcctccatatccacgaacgcttcttctccaagcttgaagaagttatagccgaagtcatgatacagcgccagatcttcacgttcgatctgataaaacatgacactcagcccctgcttatgcgcttcattcagaaattcttcaatcacaagcggaaaagagtctctctgtcctgacggatcaccgagcacgacaagccttctggaaatctggctgaacaataaaagcgctttgccgtcgcttgagaaataaaaccgcttatccccgagaaagccgagatggctgagtgcgtttccgccttcttccgccaaaaaggacttcagccgttcaggatcggccttttctccgatcggcttcgatcttttatgataaaagaacgtaaacaaaaggaaaaacagcggcacaacaataatggccgtcatcgtggcatatgtaatgtgcgaattgttatggacgaaataatcgtggcgcagcagccgattcattttatcccaaataaagccggcaatgagattgtagttaaacaaggcgataataaacagagcggccgcaaaaatcatctggccgagcgtatacgaagcctgctctctgataaactgccgctttaacagcacaagcaatacgatgacgacaggcagaataaagatcgcgctgatgttcaatccttttaagaaactgaacacaaaaccgccgaccagcgcggcaaccgccattgaataagaacgtttcgtccgtttgtataattcaatcggcaagattaaaagaatcaaagccgcgcttaacgataacgcgttaaacgcaaggagcgccgggcgcggaatatgcgggatgaccgtctccctgtcaatcggcagggcgacggacgccagcacgaccactcccgccatgaaaaccaaaagcgacagcgaaccgtaaagcaccctgattaagatagcgcgctggaatacgagaagcacgttcgtcgtttccacggcgggcgccatcttcggatttgattccagccgtttaagcgtattttccgttaaatcgccagccgcaaagaacagcccgaacacaaacggaataaatgaatacacaatccggtagatgacgatggatgtcacaaccgcctcctgcggaaagcccatattctgcatgccgagcagaaacagaaggtcaaacgaaccgaatcctcccggcacaagactgatgattcccccgatagcggcaatggcaaatacaccgaatacatggcggacatccgcgtgaattcccatgacatacaaggaataatacatgacgacagccgccgcaaaccattcagcaaacgatgccccgatgtaagaaaaaaccggatgcctcggttttgcttcaccgtcttctgcgccagcttttttattgttgatcccagcggcgattaaggctgccggcacaataagcgccactccggcgataacagcccacagccacggtttctcacctgtaatctctccaaccggcagaacgcgggcgatggtcaggatactgaagacggacagcccgagcagcgctgaggacgtaagccaggcgatgcctgcgacgaggcgttttacgtcattcgtatgttctttgtaaagcatcgtccgcagcccgacacccgccagaccgccgaatccaaggacattgttaaaggaattggcgataaaagagaccctgaatactttccaattcggaatgttgaggcgaagcgtccgtttcagcacaaagtcataaaaggacattgcgctgacggcaagaaggccgagcagaacgagaataaataaatcgtaacgctcaatcccgttaataatgtacagcgttcgtttaaaagaaaggtctgtcaattcctttttggactgataaatgactaaaagcaaaactgcaataggaaataatacttttaatatcgataaggcattctttttagtcagcaatgttctctccaatcatcataaaatagcttatttattataattcccccaataatctccaacatattatacactaccacctcacattcaaacaaaactcgtctgcaactttctttctctgattaaaatcagtaatatggtatgcaggagtataaatgaggaagtgagacgatggattataatctgtatgatacaacagtattaagcggcgatattttttctcctgaggaacgggatatttgggtgctgtacatgaaagtgatgacatcggcggggctcggcgatgtgtcggagtggatgaagcttgatatgagcatgccgcaaatgaaagtgctgatgcttctgaacaaccacgggacgcttaaggtgagtgacatagcggagaaaatgggcgcttccctttcaaatacgacggggctgcttgaccgtttagaaaaatcaagtttcattacacgcgctccgtcagaagaagaccgccgttcagtcgtcgttcaattaacggaaaacgcgaaagatattttccgcagcctttatcaaaaaggacatgtaaaattgaagcgttcattggaaacactgaccgctgaagaaaaacaaacggtcaatcaagggcttgccattttggcaagagcgcttgattcttccaaacagggatagagatgaaaaaggcctgccggtatcggcggcctttttttgtttgacatttaattcacttgaagtgaataatatattcgaagtgaattaaaaacaggaggattgatcagtatgccggagccattgcaaacagaaaaaaaccagagccgggccatcactctctttacgatcggtgtgttcatggcggcgctggacaacggaattatttccgctgctctgacgacgattaacggctcttttgatgtttctccttcatggggatcgtggggagtgaccctttacacattgggactcagtgtcagtgtgccgattgtcggcaagctgtcggaccgatacgggcggaaaaagctgtttatgattgaagtcgggctgttcggactcggctctttgcttgtcgcactcagtcagagcttccccatgtttttggcggcacggctcattcaggcgcttggcggcggcggaatttttattatcgggagttcgcatgtgctggccgtgcttccgaaggagaaacaagggaaagctctcgggcttttaggggcgatgaacggtatggcggccgtcctcggaccgaatatcgggagctttttgcttgatgtaaccgggtcgtggcattggctgttcttgattaacctgccgattgccgccgctttggttgtgtgcggcggtttgtttatcgctgaaacgaaagagcctgaggcgaaacggcttgacctcgccggcacaatgctgctgtctcttgcgatcttatcttgtatgatcggtatcacgaatctcgatggggcgaagctgtcagaaagcataatggacgtaaaggtatacgggtatcttttgggagctgcacttctctttctggtgctgcttaaggtcgaaaagcgggttgaaaaccgagggggcgatccgattctcgcctactcgctgctgcaaaataaagtgtttcaatggacgctcgtcatcggatttttatcgggagggctgctcgctgcggtcatttttattccttcttatgcggagcaatatttgcacgtatcggcggagaaagcgggttattggatgacgccgctcgcgttggcgtcaggcatcggagcgtggctcggcggggcgatcacggataaaaaaggtccggtcttttccgcggttgtatcaggcgccatcgcatttgcaggcttcagcctgtttccgttatgggtgacggataaatgggaatttgtcacagcgagtgtcattgccgggatcggtttcggatttctgctcggggctccgctgaatgtgcttgtatcagaaacggcgggccaaaacaaaggaacagcgctcggcacgctgtcactcgtaaggcaggtcgggctgacgctcgctccggctttatatgccggcttcattacagcgggctttgaccggatcggagatgacatcaaaaaccgtttagcgaaaagcggcattcccgctgatcaggcgcaaacgccggatatcggcggcggactttcttcgttgcaggagcaagtgagccgaatccccgttcccgctgtcaaaaaagcggtttctgatgcgattgaagcgggcattgccagcggctaccaccatctttatacggcagccgccgtcatttcattatgcacgattgtatctgcggctgttttggcgtttttccgaaagccggcaccctctaagacagatgccagcccatcctccgggaaagctcagtaatatgagcgatgtgatgttcagagtgccagacatatagtccgagcgcttgttccagcgtaatcgtctctttagatacaggatggaagtatgtccgtttgaattgggcttccgtcatggagcgcaaaagagcggcccatcttctgtgcaggatcgttaacagctcaagcgcatccccgcaagcggcggttttggaatcatgaagagcggcccagcctttttcatcataaggacggatttccggttcattctccgttaagctcaatttaaaccgggtatagccgttcatgtggctgtccgccagatggtgaaccacttggcggacagtccatcccccttcgcggtactgcgtatcaagctgactgtccgacatcgctctgacagcttgtttcagtttggccggagcgtgttcgagcgtattgatccattcttgtttctgtccggccgaaatcgattcagccggctgatactctccaatcggatagctgaggatttgtttttccatttttgtctctctcccgttgatcgtattatgaaagtatgatggtgatgtcgcagccttccgctttcgcttcacgaaagacctgaagcacactctcggcgccattttctgtaagctgcttgctttgttcaaactgtctccattctaaaacgagggggtattccacccagccggtcagacaatcccataaagcgtcaaggttttcaccgtagtattcgggaagggcaagttcctttttcaatgtctggtgcaggtcgctcatacttctgatttgctccccattaataactgctttattcatgcgcggctcctttcccatgtttttattctatcagtttaccattttcctcttcagaagtgaccggagtctgccgcggttccagctggacaatgccttgcccgccgtcaacggccaccctgtcccccgttttcagttttgacgttgcatttccgcacccgacaacggcaggaattcccagttcccgggcaacgatcgccgcgtgggacaaaggggcgccgacgtccgttatgatagcagccgctcttggaaaaagcggggtccagcctacattggttgtcgaagtcactaaaatttcccccgccgcaaaagaatccccgtcttccggagcatcaaggacacggacaatgccctccactctcccggccgctcccgcgaaaccttttaaagtatgcgcatcatcagtttccgccggcataaaagcatcgtaataatccgctcttctgtcaggatcttcagcccatttaaacggattgaaccttccgttaataacggatgggaacggcggcagttttttataggtttcatagttttgctttctcgcttgaattgacgcaaccgccggctctttccccgcgagcagatcggttatttcatgcagatacaagaagaaaatatcgtccttcatgccggtcatttccgccgctctgagcgcgaatgctctggctgtccggtacaccctgacaaattcggatctggttgtctctctaatattcgcgtattctgacgctttttccattttggctttgagccatttgaccttatgaggaaacttttcttcaaatcttcggaaggcctgttcatgcgcccgctgctgtttcaaaagcagttgttcggcatcaatacccgactccttgtgttctttgatctgcttcgtcagccaatcccggttttctcccggatgcggtatggaaagttcgtattcatgcgggccacggtggccttggttcctgagatattcttcctcgctcatacggcctttcatgacttgatcaatgccgataatcggctccaggctggccagtccgccttttcccctcagattggacagcaggagattcgcatcttctatccctgcgagttttgttaattgagaggttaacgacgaagaggattgcgcagaatcacgcccgccggatattaacgcaaaccacgcgttgcataaatacggatagatctcattgttccatatcgctaataatgcccgctccgtttcggcccgtttcagcttttcctcaatattccggcaccactccggcgattcgtccaagtaggaggacatgttttttttcgcgagcttcattttcgacagatacggtttcagttttttcgagatgatcttcaaaagttcatactttgagaacggatataaaggaatcttcatttccgccgggatttctcccaatgtatcgctcatcatttttcctatttttccgcctttcggattcagaccgaaagcggcgagaacggaaagaggctggctcatattgttataggctcttccgcaaatattgccggaccagacataatagcccggaatgatgcccgactcttcatccagattccggaggagcgaccatgtcagcggcgtcatcacatcgggaatcgcttctcctatatttgtgtttgtccataaaaaatcaccgctgaaagaatcattccattcataggtttccagatttccggcctgtaaggtcgtaatcgggcgggattgaagaatatacaatgtctcgcccgcggcggcccattcaatatcctgcggccctccaagatctttttccagctttttcgccagtttatagagctttgacgcatatttgcgaaattccccggggccgtcatattttttcttgggccgtgccagtttaaaagaataggcatcggcttccccggaaacgagctgctccccgagaccgtagacgtaattgcctgtcatctcccgcctgctccccgtaatcggatctgcggtaaacagcactccggatatctcagacggtatcatcagctggatgacgattgcgatttcatgctcatcttccattccctgaacggcgctgtacgcttttaccctttctgactgtgccgatcggcggacttcatcaatcgccctggacatgtcttgatctgttttgacattcaacaccgtatcgaattctccggcaaaggaagcctgagctgaatcctcgctcagcgcggatgagcgtacggcaaacaacgcagatgcatggcggctgcggatggatttcacatattgatcaatagcctctctcgcctgatggcgcagctgtccgtcctgaaaggcagacggcaaaatcacaaacccttcaggcacaggatacccgctttgatacattttagagagaatgcttccttttcctcccgcaaaggaataaagttcgtccggaagttctccgaatgttttgacacagtcattcataatgtccccgctcctttttagtcgttcatccaagctcacagtttttctctttttcactttttttgaaagtatttcctataagtatacaatatatcggtcttcacaagggagaaaatcgatggcgttatgttgtcataaatgcatccgtcaaaacggccgcagcggggtcttcagccttacagtgaaagcgctattaaaattagagataggctgcccgatactgcttgcctggcattcgcttccggcttgccgcggggggtttcgtttgcaggttatgtcaacttccgtatcaaaaaggcggccgaaacgccgcctttttttcagactgtgcggccttgatgcgccgccgtatttcttttggtctgcttcggctgatacactttcccgacaaacaggtatccgtatctgaaatggttgcacacccaagataagaaaatgggaccgagcgtgcagatcaaaaataaaagaaggatggcagccgctaaaggcattgatcgcaaatagccttccagaagatatccgctgattaaaaagtaggagtgcagcagatagattgaaaacgaatagttgctgatcatcatcacaatcgcgggcacttttttgagctttgaaaacagatgaaaacacagaaagatcatactgaccgcgtaaatcataatatccggacgcttagaggaaatggagccgccgctgatatatgaaacggccacaatcaatattgccgatacggccgcactgaagtaaaccgcataacggtactgattgatgagcgataaaaaacgcggatattcctttccgcaataaaatgccagacagaaataaaacacccagcccggaaacggaacccaaaagaacggaaaaatagaatcaagccccgatgatgccggcggatgaaagatggaaaagtaagccagatagacggcgttgatgataaacgaaacagacagcacccacatgggagatgtgttgttcagccagcggtgcagcagcatatggagaatgtaaaattgaaagatcacaagaatgaagtagccgatgaagtttcctaaaaacacattctctaaaaatttaccgatcactgaaacgaagccggctccttcttccgccacgcttttcattaaaatggcatccaccgcggcaataaacagaaacggcacgaaaatgactttgccccttttctttaaaaaacccgcgggaacgcctcccgggtatgacctggcaagcagaaattccgaaataaagataaacgccggcgtgctgaacatcaacagggtccgaaaagcatcaaccgtatgggcggcactggctaaggactcttcctgaatcatcagcaccattgaaactacgtgaagcagaaccacacttaaacaggacaggcagcgaatcacgaaaatttcttttatctgcatgcggccgctcctttttcacaagcgcgccggactttagcgtatgcttggcgcagccatttttcccgcagctcgggtgtgctcgttttgacgacagaaaaaaggttccgctcggctttttgaatgccgcaaaattgcagaatgccttttttcagcgtaatccagtccgagtttttccgaaaccactttaagtaccagcccggggaatccgccgtataaaagacctgtgccgtctctgcccggagcagtccttttacgcggccgttttcatatgtgtaggcttctccggcgacaagcactctgtcaaaaaagcctttcataatcgccggaacgcctccccaccacagcgggtagatgaaaatgagatgatccgcttctttcatcagtttccggtatttcttcgtttcagcgtcccggttcatgtcagagcgctttttttcgccgccgtacttcagcacgggatcaaattggtcggcgtataagtcaatgaccgtatagctttggccgctatcctttaaagccatgacgacgtattttacgagagccgcattgaaactgttctcatccgggtttgcatacacaatcaccgtcttcatatgtccctccattatttcttaatttttacaatgattatatcatgttgtcatatgaatgaggcaaagacatgagaaaggctttttccagttctgctgccgtttcgataacccctttctgcatattttcgctgattttgccgccgcagattcaatgacaagcatccggcacttctgcgtttttgagcggccgtatggtatactagctgtcaaatgaatggcttggaggacaacatgagaattttaaagtacgcgattttagggcttttgcgaaaaggcgaattgagcggatatgatatatcgagctattttaaggaagagctcggccagttttggagcgcaaagcacagccagatttatccggaattaaaaaaactgacggctgagggatttattacgtttcgcactgcgattcaaggaacaaagcttgagaaaaaaatgtacacgctgactgacaggggagagctggagcttgctgcttggctgacgaaaaaagacccgattccggaaacggtgaaggatgaatttatgctgaaggcttatttcatctcagctttgacgcaggaagaagcggatgagctattcaccgaccagctcgtaaagcggaaggagaaattgtccgatctggaaaacagttatcaagaactgatgacatcgtccgcggaggcggattctttttcttctcctgatttcggccattatctcgtgctgacaaaagcgcttgagcgggaacggaattatatttcctggcttgaagatattttggctctcatcaaaaaagcataaacaaaacggggcggctctgtatctgcaagccgcctgtttacgttctgagaacttcattgataaacgaatcagccattaaaataagaaaaagcagactgaaatacacaatcgaataaaaaaacatccccttcgaccattgcgtgtcatccgccgcctgaaagcctttgacgctccggtacagccagatggccccgagcaggagagcggacgcggtataaaacgggctgacgtctatataaagaggaacgagcagcgaaaccgcagtcagaacggcaatatagcgcagcatttttatttttgtggcgcggttgccttttaaaatcggcaaaagcggaatgccggcggcacgatactcttcctttcgcctgattccgatcgcccagaaatgcggcggctgccacaaaaacataatcgcgtataacaaaatcgcgggcatatcaatgtacccggtgagcgcgcaataaccgattaaaggcggagccgccccgggaaaactgccgacaaatgtgctccagacggattgtcttttaaaccaaagcgtatacacgacggcatacagcaaaaaggcaagcaggccaagaacggcggtcagtacattaagcgaaacaagcatgatgaatccgcatgcgccgagacatgtgccgtacaggatcatgaccggcggcggtattctccccgtgacgctggcgcgggtgcgggttcgcgccatctttgcgtccatgccgcggtcaaaaaagttattaaaaacagtgcttgatgccatgactaacgccgttccgatcatggcaaccgccatggcggcaaatataccgggccctccgcccgtcctttctgactgaatccatgcgatccaaaatccgcccaatgcggcgagtgaatttgagatgataatccccggtttggcaagaatgataaagtctttgaccgtcatccggtttccgttatgcttcatcggctgttccgtctgtgctgcatttgagttcatttgttcaggttctcctttttcggcttatcatatcaggaagaatcagggagcacaatttattttggacatttttcacacaattgtaaattgtatatgaaaagccgcatcttgtgaccggatgcggcttttgcctttttctattcaaatcctgcccatacagctttttcaatccggcggatgccccgagctcgggccggcgatggcggctccacgcgtcatttttgcgcctcactgagatgttcgctctcttcagtcactcaaaagccgtgtggatattgcaaatcgacgttcttctttcccgagccttttcaagaaaacttcagaaaaataaaaaaccttgccgattagacggcaaggtttgtttcttacagtgtaaatgcgatatccgcccctgatacagggtctttgacgaatacgccctcttctttttcttcgatctcaaagccggcatcggtcagcgcttttgtcacacgtgacagctctttttgatgcggcagcgcggtggtgtaataatccagcccgcttgcatttcccggtttcggcggcgcatgttttccggcccatatattcagaccgatgtgatggtgataccctcccgctgaaacaaacagagcggacatgcccgcgtaattgccgacaatgtcaaaaccgagaatatcggtgtaaaacgctttggcttcctgtaaatccgtcacatgaagatggatgtgaccgattacggttccttctgggagacggcttttccgttcagctccggcttcttccaaaagcccgtccacatcgacgggcgccgtttgcatgacataattgccctctgcatcccggcgccacgtgctgcggggacgatcggcgtatatttcaataccgttgccgtccggatcagacaggtaaagagcctcactgaccgcgtgatccccctgaccgagcgcgatgccgttttcaatcagcctggccaatgcgatgccgagttctttccggtcaggcagaagtatcgcgaaatggtaaaggccggtgacagaccgctccggcagaacgacggcgcttggattttcttcaagcaccagcaggacgcgttttccgtctgctgacagtcttgctgaacgatctgtctgcgagatgacttgaaggccgattacattccggtaaaagccgagcgagcgttccatatttttaatggtcaatttgacataaccgattgccgtatcttgatgaatgccggtcatttgaacgccttctttcttatgctgaaaaagtttctcccttttttgatttgaaaaggagctgatccaatgaaagcagacggcttcctgaaagcgctaagtgaattgacgcaaccagtaagatgaaatcaaattcagatccgcccataaatggtgaggaaagcttcgccgtgaagatggcgccgactaatgtgacggcaaacagaacgccgataatgcgcgttgccaaaccgaaaaagatcagaaccccgccgacaagctcaatcgtcgcgatgacatagaccataaaggccggaatcccgatgctctggaaaaattgcgtagttccttccaacccttgaaacttggataaaccgtgaacaaaaaagataatacctgttacaacccttaaaagcagtgttcctgtttcgaatgatttattcataaaatcctccttgaaaattattatcacttactttatgtaagctagtatatatacataacttatttacgtcaagtaattttgttacatttaacgaaaataacttaaaagtactatttgccttcgcgaaaaaaagacctccgcactctgtcggaggtctttttccctatctatgattcccggaactggctttcatataattcccggtaaaacccgttctggcttagaagttcggcatgggttcctttttcagccatttcgccgtctttcagcacaagaatctgatcggctttttgaattgtgttcagcctgtgagcgatgatgacgcttgttctgcccgtcattaaacggccgagcgcttcttgtattttcacttccgtcactgtgtcaatgttgctcgtcgcttcatccaaaatgagcagcaccgggtccgccagcacagctctcgcgatggaaatgagctgtttttgtccttggctgatgcccgcgccgttttgggtaagaacggtatcatagcctttcgggagccgttcgatgaacccgtgggcattggcggcttttgcggcttcctccacctctttgtcagaagcatccagccggccgtagcggatattctccctgatggtgccctgaaagagaaaagaatcctgcaggacaaaccccatattttttctcagactggatctcgtcagttttttgatgtccgttccgtcaatgaggatttttccgttattcggctcgtaaaaacgggcgatcaggctcgtaacggttgttttacccgctccggtcggtccgacgaaggcgattgactgtcctttcggaacgctgaaggacaggtgttttaagatcgggctgtcttcctgatagccgaaggagacatctcggaattcaatctctcccgttttgatcggctggtacagcgcatgctcttcatcttcccgctcctctttttcatcaagcacgtcaaacacccgttcagccccggcgatggccgataacatcgtattgaactgattggctaaatcatttaaagggcgtgtgaactgccgcgagtattcggcgaatacgacgatggaaccgattgaaatccatcccttcagcgcaaacagcccgccgaccgccgctataatcgtaaagcttaaattgtttaaagagttcatgactttcggaatgaatcccgaaattgtctgcgcccaaaaccccgatgattgtaacgccgcgtttttttctaaaaattgttccatgacgcggtcttccctcgaataggctttaatgaccttcgcccctgatatcgactcttcaataaaaccgttcagctcgccgaggtttttctgctgctgcttaaacagcaaccccgtccggttggtgatccatttaatgctcaaaagcatgatcggaataatcaaaagggtgatcaatgttaaaagcggactcatgtacagcatgacggagattgtgccgacgaatgtaatgacgctcgacagcacttgaatgacggatgtatttaaagtggagctgacattttcgatatcattggtgacccggctcattaagtccccgagccgctgtttatcaaaaaacggaatcggcagctcatgcagatgggtaaacagctcgctccgcattttaaacacggtgctttgcgagatattgatcatccaatagttttgaaaccataaggacaatgattgcacgaggtaaatcccaaacaggatgaacagcacccccgccaatccgtctgtcgtctgtccgacgataaaatgatcaatcgctttcccgatgacgaacggtccgagcaggccgaatatggcgcttatgactaccatgatgatcacaagcgttaaaagcccttttttctcggctacataagaccagattctgcgcagcgtgccttttgtatcttttgctttcgcgcgttttctgccgccttcatttgatttgagcggtattttcggatatcggaaaggtttacgaatgtctttttgcattgtcagctccctcctttccgaattgtgattcataaatctgccggtacagatgagactgtgccatcagctctttgtgcgtgcctttggccagcagttcgccgtcttcaagcaataagatggtgtcagccttcattgcagtcgttattttctgcgtaataatcagtgtcgtgcattcataggatctgatcgcttgtaaaagcttcgcttccgtttgaagatcaagcgcgctcgtactgtcatctaacagcaggagggacggctttctgataaaagcgcgcgcgatggaaatccgctgcttctgcccgcctgacaaattgacgccccgctgtcccagcaccgtgtcgtatccgtttgacagcttcataatcgtgtcatggatttgcgcgtcttgggccgcttccattacttcatctagtgaagcatcctcccgcccccaggcgatattttcacggatggtgcccgaaaacagaagcacttcctgcggaacatagccgatttccctgcgcagcccgcaagcggagaattcaccgatcggtttgccgtctatgaaaatactgcccgaatcagccgtgtacaggcgcggaatcagctgaaaaagcgttgattttcctgaacctgtcgcgcccataatggcaaccgtttctttcgggctggcagaaaaggacacgtgatgcagcgcgtctttttccatgcccggatagcggaaggacacttcgcgaaactcaatcccgcctgcaagcgcccgtgccgggtcctgccccgttccctcgccgccttctgtttccagcacctcgccgattctttctccggaagccttcgcccgggaaaataccatgatgagaaaaggaaggacggacagcgcgcctgtaatccgcgtcgcatagttaatgacggaaacgacatcgccgacctgcgctccgccctgagcaatgcttttggcgccgaaccataagataaacaaaatgcaaatgttcatcagcagcattaaaatcggcatcgccgcttccacgagacgaaaagcggagaccgttttttccatcagcttcgtattcgatttcaaaaaacgtttcacttcgtggtttgcacggaggagcgctttaatcagtttgatcgccgtcaggttttcctgcatgatcgtgttgacctgatcaagccgcttttgcacagaccgaaacagcgcgccgcctcttttcagcacccacagcaaaaacaaaagcaaaatcggcaccgtgatcagcagaaaaaacccgagtttcgcattgacggtcagcgagagaataatgccccccgcgatcattaacggcgcacgaagcataaaccggagactcatgaaaagcatattttggacctgtgtcacatcgtttgtcagccgggtgataaacgatgtggatgagaattgcgcaaacgtcgaataagagaaggattgaattttttgaaaaagcccttttcgcgtatcatacgcatagctctggctgatgtgggcggagtagaatgaatttaaaatgcccgatgcgaatgaaacagcggtcagtccgatcatcacgccgccccacagccaaaccgtaccgagatcctgctttaaaattccttcgtcaatgattttcccgatcagcaggggctgtatcagctctaccgcaagctcgatgagcatgaaaaacagagcgattcccgccaaaagagaatacggttttacatatgataaagcctttgacatgtgtaagcctccaaatcctttgttcaatattattattttatgcctttccggcaaatgaataaagaaatttggtgtgccgttttttcaataatctgcgaaaaagataaaaccttcccgggaagggaaggttttgaccttattgatccaattgctgttcaatacgctcccgcatttgcggaacccctaatccgacaatgacctgaagcgccctgcctttcctgacgacgccgtgggctcccagctctctgaaatcggcgtcacttttgacctttgattcatcagcgacagtgacgcggagacgggtggcgcagttggtgacctccgtaatattgtcctttccgcccagcgcttcaatatacaaagcggctgtatcccgctgtgtttcgtctgccgccgctgtttcttttgaagcctgcttccgttctctgtactcctttttcgaatagagctttgtttcctgcccttcctctttttctctgcccggtgtggcgatgttgaatttgagaatgaggaaacggaagacgaaaaagtaaacagcggtaaaacacaatccgataatgatctggtatacatacgtcaagccgtggcttgacgccagcgggatccagttcaaggtcgcagcttcgatcaaaccgcctcccatatttccgacgacgccggccatatacatgacggttgccatggaagcggcaagcaaagcatgaaccgcaaataaaaacggagagataaaaaggaatgtaaattcaatcggctctgtaattcccgcgacaatggacgtcaaggtgaccgggatcaataggccggcgacgatttttttcttttcctttgaagccgtggcgtaaaaagcgagcgcgattcccggaatgccgaagattttcgagttgccgtgaagcgcgaagcccccctgcgggaacaattctttcagcggtttgacgctttgagagtattccccgagatgctgggcccaataggtgacgataccgccttcagccacagccggaccgtaaataaacggagagtaaataaaatgatgcaggccggtcggaattaaaatccgctccaggaacgtgtaaatccacacgccgatcgccccggaagaaacgagaaagctttgcagcgagcctattccggactgaaccatcggccacacgtatgccaccgcaagtgaaatcggtatcataatgaagaaagaaatgataacgatgtaggaagatccttgaaaaatccccagaaaatccggcagttttttatcaaaataacgattgtgcaaatacacgacaatagatgaaataaagatggcgccgataatattcgtatcaagcgttttgatcccggcgatcatcgtcagcccgctcgttccgcccgcttcctgagtcatatcgacatgaaaagccccgccccaaaccgtcagaatcgcattgataaagtaattgaatgtcagataaactgtaagcgcttccaaacaagcccgcgcctgcgcttttttcgctaaggcgacaggtatgccgatcgcaaacaggagcggcatttggttaaagacggtccagccgccctgttcaatgacgtaccagcattgataccaaagcccgtcaggatcagccaggggccccatcagcgttttatttttaaacagcgtactcagaccgacaataataccggaaaatgcaaataacaaaacaggcacaaacatcgcgctgccgaagcgctggactttttgcatcatttcacgtgacctcccgctatttatcaaaattttcaagctctttataatcaacatatgcacggaataacgcttcgcccaccagaaaaaacggggcgaatgcgacgatttccgttttatcgcttaacgtcaccggcttgctggtcgcataaagattatacggcgtcgtttgcgccagtacgttgtttttcagattggtgattgaaataaacggaactccctttgcggacagggtccttacctgcggaattaattcgggtgtttcgcctgataatgaaataatgatgaatacgtcatcaaccttaaaatcatcacacatgatattaaactctgtgatgtcctgaattaaaatcagatacttccgccgggatacaaacatccgctgcagctcacgggcgcacaccctctgagccgtccccgatccgtaaacgaaaatccgttttgcttcatctatcagccggcacatctccgtcatatcttttgacttcacgtattttacattggcttcaatatcatccagcagcttttcaaacgtcatattctcgccctcttcaggctgatcctcccatttcagaaaaacccggaattcactgtagccgctgaagcccagtttttgggcgagccgcaggatggaagaccgagagacattgcaggctttcgccatgtcattgataccgagatggtagcacgtatgtttatgattcaatatatattttaaaatataaaaatcgttgtcatttaatttcgcgtaatgctgattaaccagttcttcaagactcatcccaaaaatccccccgttttctttctattatatagaataacagataaagaaaacggggaagattgtcatcaggaaataggagacggacttacatcaagctcaggccagtagtccttgttagcctccatcagatcttcaagaatcagtcttgccacacgggcgttcggcactgtttttgacaggatcagcgcctgccacagcttttgaaatgaccgctcttcccacgcttcagccgtcagtttttcaacagacacctgctgttccatcaggcctttttgaaattgcggtatgttcccgactgagagcggttccggtccgtttgagcctacgagacaaggaatctcaaccatggctgacggatcaaagtttgcgatcgcgccgttattttcaacgattaacagcatcctctcccctgtgttgtaagcgatggcccgggcaaggtcgacgatataggaagcatgatcatcaattttaatttcactgttctccgacgattgttcgcgcgtaatcatatcgcattggctgaaaatgaaagcttcccgcccttccatgacttcgttggctctcgtatggttcgggtttgattttttcaccatatcatccgggaataagtaatattgcagatatgtgttcggaagcgtatccggatcagccgcctgtacgtcgcgcgcttttttgaatgtgtcattccagcttgcttcagtctgttcggcctccgtcttcggaacgtagccgtattcacggacatgctctttcagcttcggcattaaatcattgccatgccggtctgtgatggacgtccaccagccaaagtggttcaagccgtagtaacggacgttcatttctttccgtgaagataatccgaggatgttcgccatgcgatcctcaattccgaccggcatgtcgcagatgttcaatatttttgaattcggtctgaggcgccgtgtagcttcggccacaatcgccgccggattggagtaattcagcatccatgcgtcgggcgagtacgtttccatataatcaagaatctccagaacaccgccgatagagcgcatgccgtatgcgattccgcccggcccgcatgtttcctggccgaccacgccgtacttcagcgggatttgttcatcaagcgcgcgcatcgcatattttccgacgcggatatgcgccatgacgaagtcaacatccgtaaaagccgtctctgggtcatcagtcgccagaaattcaatgttcggcgctttttcttttataaatacctcacacgcacccgcaatccgctcctgcctttctttatcattgtcataaagtttcagctttctgatcggaaactcttccaggtgattcaaaagcattaatacaattccgggggtaaatgtgctgccgccgcctgcaataacgattgagaatgatttgtctgtcatgtgaagccctcctctgataacgtttacattttatttatatcatgagaaggtccgatctgtaccgggtttggaggagttagatcatttaatcatttttagttatttttctcaaaaagcgggaaagttcccacaggtacgaaaaaggcctgctgtcatcagcagacccattctcaaaaatgctcttgtaaatcagaaagcagcacttcctgctcaaattgcggatttccgatcggaaaaattctggctgtttccttgtcttcgttgacatgctgaatataaatcggaactccttcgtacgtcacatacgccatggcggcggattccgaaatgtctttcgcacgctgtgtattcacgtctcaaacctcctttaggcctcacacataacgtgtccggcagccaagagaagtatgcttgtttcttacaattgtccggtggtgagtttgaattttttgaggcgtttgtaaaacgtgctccgcgggattccggccattttggcggccagcgtgacattccccttcgctgattcaagggcgtttacgatgatgtttttctgaatgtgctcccggatggagacaggggacgcttcttcctgttcataagactcggccgcctctttaagacctgacgcttcaagcagggctgcgatggggcgttctgacagccgtccgtccgggaacatgacggaaagacgttcaaatacattaaacaattccctgatattccccggccatttccggctctttaataggtctaaaaagtcatcaggaagctccccccgccagccgcgatttcgctgaaattcaaggaagaggccgggaatgtcttcggtgcgttctcttaatggagggaggtggatcggacagacgtgaagccggtaaaataaatcttctctcagctttttgcattcgacaagctgtctcagatcagtgtgggtggcagtgatgattctgatgtcaacgggaatctcttttgtcccgccgaccggggtgactttccgttcctgcagcacccgtaacagagcgacctgcatggagtgtgatatttctccgatttcatcgaggaaaagcgtgcctttatcggctttttgcaaagcgccgttatgtcctttccgtttggccccggtgaaggcgccttccgagtagccgaacagttcgctttcaatcagcttttcggggaccgctccgcaattgacggcgataaacgggccgtttttcctggaactgttgttatgaatcgcccgggcggcaacctcctttcccgtcccggtttctcccgtaagacaaacggttgcgtccgttcgggcgacaagctccagctgctgaagcatatgtcgggatgacgggcttttgcctgccgcaccatggaatataaaagacggcttttcttctcgtttggataaataaacgcatgtgtagccgttctcctcccgcttcgcctgcttgatgtgaaagccctgttcctcaagctcgcgcagcgtatgtccggtaaaatgctgaacgggacggcttgcggcgataacccggctcatttcattgcaaagcacgatcggatcgtgagaccgggtaagcccggcgaacttgctgatcatgtcaagttctgtcattttgatctttagggcaagctcccgttccgccgtataagcgatggaggaggcaattccgagcataaacggctgagcgcgggcggcggggcaggaaatatcaatgacacccgccagccgcccgtcttcataacggatcggcgcggcggaacagctccattgatgagaagcgagcgaataatgttcagagccgtgtatcatgaccggctcttttgtataaagagccgtcccgatcgcattcgtgccgacggccgtttccgtccagcgggcgccttttaagaaattgatgcggttcgcttcatgaatggtgcgcgggtggccgtcaactgaatggacaacgccgtctgaatcaatcaggagaaccatcatttccatttcccgcatcgccgttttcattctttctgcatacggcgttgaggccgctaaaaataacgcatgcttttcggcctgcctttctaaatgatctgccggcattacattcggccccttttcgagataagggttgacgtcggcttttttgcagcggtgccatgaggcggccacccgcttctgaatacgggattcatcaagcacgccttctttcacaaagcgcttccaggttttaaaatcattccgaatgacattcattgtattcgctcccccctgttcagaccatcttttcatatattgtaggggaaaaataaagcgctttcaacgaaaaataccccttctcatctgagaaagggtattccggttatacggaatgcaccgcaagtccggtgacattcagcagggcttcctgaagcgtttctgacagagtcggatgcgccgcgataaagtgctccgacatatccgccgtcatttcaccgttcatcatcatgaccgcctgaccgatcaattccgtcacgtccggcccgatcattgacacgccgacgatttctccgaattccggttcggcaatgattttcattttgccgccatgctgatgtttaattaacgcttttccgttagcagaaaatgagcattctccgattttcacatctccgtatgtctctctcgcctgtgtttccgtcagcccgacagcggccatttccggcgatgtataaatacagcggggcaccgcccgcatattgactttgctgtcctttcccgaggcatgcgcggcggctgtgattccttcatgaatggcggcatgcgcgagctgcattcctccggccgcatcgccgcatgcgtatatatgaggcacattggtctgcatatggtcattgacttcaataccgcgcggagaataccggatgccggcctgctccagattcaggccttgcaaacgcggttttctcccgattgcaaccaaaatgtgatcagcctgagcctcaatttctttgccgtcttttgtccacacggcggttttcctttctttgtcaatccgctgaagggcggctttcgtctgaatatcagccccgctgtctcttaaagagtcttcgaaaacggcggcgatttctccgtcttctgccgggagcagccggtcagccgattcaatcaccgtcactttcgttttaaaccggctgaataaagaggcaaattcacagccgatcacacctcccccgacaataagcagagaagaaggaatttgctgtaaagaaagcgcgtctttgctgtcgatcacccaatcgccgtcaaatggggcaaacggcagctccgccggttcagatccggatgcaatcaatatccgatccgcttccagaatgtcttttgcgcctccttctccttcaacaagcaatgtctgctctgtgagaaatgaagctgtcccgctgatgactttaatctgatttgctttcattaagtattgaattccctgcacgagccggctgacgatttgccgtttgcgcccctgcatgcgggcccaattgagtgtaatgttttgcggcagttcgatgccgaatgtatctgcatgcctgattttatcgagcacattcgcgctttccaaaagcgactttgtcgggatgcacccctcattgagacaagtgcctccgagcggccctttgtcgatcagaacgacttcttctcccctccgcgcggcagtcacggcagctgcatatccggcaggcccgccgccgataatggctagtgtcaatctcttcaccctctctataaaatcaatccggccggctcttcaagcagcgctttgaccgttttcaggaagtccgctgccggtgcgccgtcacatactctgtggtcaaaggtaaggctcagcggcagcatggtgcttttgaccagctcatctcctttaaacgcaggcgtttcatagcttgcgcctactccgagaataccggcttcaggcggattaagaatcggggtgaaatgctcaattccgtaacccccgagatttgtaatagaaaatgtcgatccgtgcaggtcatctccggaagcattgccttcccgcgcccggcgtgccgatgtgctgatgtgatccgcaagctcaaggaatgaaagcttttccgcatcccgaatcaccggcacgacgagaccgttttcaagagaaaccgccatcccgaggtggacatatggataggtgatgatccgctcctcttgataagagctgttcagctcaggatgctgtttcagcgcaagcaccgcggcccgggatacgaaatgtgtgaccgtcagtttaacatcgctccgctttttcgcgctgtcggcgagctgctgctgccattttacaagctccgtaatgtccgctttcatagtcagcgtcagctgggcgctgttttgcaggcttttgtgcattcggtctgcaattacttttctcatcgctgaagccggttttccctccggctgtgccgtctgaaccgaagactgcggttctgattccgtcttcatggccttgatgacgtcagcttttacgattctgcctccgggccccgtcccgttcagcgtttcaactttcaacccggctttctccgccatttttcgggcaacgggagatattttcacgcggtgtttacgcttttgcacggctttgggagcgggaatatgttcaggttcagattgcggtttccctgcattttcaggagccggcgcctccttctcccgcacttcttcgccgttttccccgatataacagatgggcgttcccggcgggactccttctccctctttgactttaatatggagaagcgtgccgctttcaggcgcttctatttccatttctattttttccgagttgatgctggcgatgctttctcccttttcaaccgggtcgccgacttttttattccagacggatacttcacctttcttcatcgccattcccagcttcggcattactacttttacagccattctatatccctcctttaattcattgccggctcgccaagcaattcaagcgtgacgctgacaatttggtctggtgtcggcaaatattgatcttcaagcaccggcgaaaacggcactggtgtatgcggcgctgtaatccgtttaatcggtgcatcaagcaaatcaaagcccttatcggcgacaatcgcagcaatatccgtggcgatgctgcagcgcggattggcttcgtcaatgatgatcagccggtttgttttttctaacgatgtgaaaatcgcttcctcatctaaaggagacagactccggggatcaagcacctcggcgtcgatgcctttctcagaaagctgcgcagccgcttcaagcgcagtattgacctgcttgccgaccgcaaagagcgtgatgtcgctgccttcgcgtttgatatccgcctttccgagcggaattgtataataatcttccggcacctcgcccttcatgttgtaggacgttttatcttcaaaaaagaataccggatcattgtcttctattgccgaaagcagcaaacctttggcgtcatatggattggacggcacaaccgtcttcagacccgggatgctggtgaacaggccatacagcgcctgcgaatgctgagcggctgcccggaatccggctccgtatgtggtgcggacggtgatcggcacttgcgctttaccgccgaacatatagcggaatttcgccccttggttgatcacttggtcaaagcacgttccgataaaatcgttaaacatcagttccgcaatcggtctcagccccgtggatgccgcagccatggccgcacccatgtagcccgcctcagaaattggtgtgtccagcaccctgcttctgccgaattcctgtacgagcccctttgtgacccccagtacaccgccccatgcttcatcatcttgcaagtgatcgaccgccgctcccccggcgacatcttcaccgattacaagcacattgtcgtcttttctcatcgcaagcttcattgcttcattgatcgcgtccgacatgcttatgactctcgccatctcacattccccctttttcatatgacacgtagacgtctgtcaacagctcagactctttcggatatggactcttttcgctgaacgagacggctttttcaatcgattcgctgacacgctgttcgatgtctgacagtttatttgcatctgtttcttttagaagatagtttttaaagccttggatggcatccttttcttcaagatgctcagtcttttcatcctttgttttataagtttgggcatccccttcgaaatgtccgtagtttctgtaagtcatacattcaatcaaagacgggcctccgccgtttcttgctctttctatcgcttccccggctgcctgataaactgctaaaatatcttttccgtccaccgtgacccccggcatattgtaggcagccgcccgatcggcgattgaatcacaggctgacgcgtactcaaatgtcgtggcttcgccgtagccgttgttttcggcgatgaacacgacaggaaggttccatactgccgctaagttcagcccttcatggaaagtcccttggttattggctccgtccccaaaaaagcaaacgcttacatttttagtttgtttatatttagccgtgagcgctgatccgcatgcgagcgtgaatccgcccccgacgattccatttgcgcctaacatgcctttatcaagatccgcaatgtgcatagaaccgcctttgcctttacacagtccggtcgcttttccgaatatttccgccatcatgccgtccagatcacagcctttggcgatacaatggccatgtcccctgtgtgtgcttgtaatgctgtcgccatcatctaaatgagcgcacacccccgcagctaccgcttcttcaccggcatacaaatggacgaatccgggaagcactccttgcgcgaacagttcatgcactttgtcttcaaagcccctgatttccagcatcttttggtacatccacagcgctttctcctcagttaatgacaagccttctcgttttaacaattccattttgtgcgcctccttctatttagggttcacacttataaatgcaagaagcatgccagcctttgaagcccgtaaaatgaatgtttttatttttacaatggagacagtttgagacaggtgtctcattttgtctcaatctgttccctttgtctcgttttaaagcatacaaaaaagaccgggcatcaccctgtctttgacaatgatcgacgtatttatttcctcggaaatcttttaactgcttcattcttctgcatacagtctatcgtggcgtttgagtggttacactcttttttttcatatccacgtgctgcagttcatgcttttcttcaacagcccgattcagcgcttgaagcatgtagccaatgcctttatacgatgacaaaggccaggtgatatgctgatgctctctgatgacggcgtttaggacgcttcggtattttttcccgccaagcatgacaagctcttcgatgtcggaaaagcctttttcatgaaattgacggcgcagctcgtccgctgccatgatctccggatgaccggttccaaaagtgacatcgtaatttccgggaaccatatcatccggacgaaggaatccgtgctttgccgacaaaattacccactcatcgaaaaatgctttcgcataacgctcgcacgcctgatgaaacgggctgagataagcgtcttccgcccttaccggacctgtatctgaatggacatcccaaatttttttcttgccgcaggggatgatgcacagtcgtttcatttttctctccccctttatgatgtatctcctatcaatgtaccatgattcgtttatttctgcatgacgaaactggccatggatctgtctgggtaaaaactgcacacaaaaagacccggaattcaaaccgaaatccgggccggatgaagaggtatttatgtcactcttgctccatcccatcaagatactttctctcaaagtcatcgagcaatgcacgcacttcatctgttgactttgtattcatgcattgatttcttaattcacttgctccacggaatccgcggagatatatcttgaaaaagcgagggagcggtttatatgctcgagcttctgcttttgaatattcatcatgaagatccaggtgcaatctcaaaagatcaagcaattccttactgctatgctctctcggctccttttcaaaggcgaatggattagtaaaaatgcctcgtccaatcataatcccgtcaacaccgtattgttcagcgagtttcaagccggtttcacggtcaggaatatccccattgatcgtcaatagggtatccggcgctatctcatcacgaagtttcttgatttccgggatgagctcccaatgcgcatctactttactcatttccgctcttgtacgcagatgaatggaaagattcgcaatgtcttgtttcagtatgtgtgtcagccagccgcgccattcgtctatatccgtgtagccaagtctggtcttcacacttaccggcagacctcctgctttcgccgcctgtattaattcggctgcaacttcaggacggcaaatcaggccgcttccctttccattccccgccacattaggtacaggacagcccatattgatatccaggcccttaaaccctaattccgccatcccaatactcatttggcgaaagttttcaggcttatctccccatatgtgggcaaccatcggctgttcatcctccgtgaaagtcaaacggccgcgcacactatccttcccatccgggtgacaatagctttctgagtttgtaaactctgtgaaaaacacatcaggtctgcctgcttcactcacaacatggcgaaaaacgacatccgtcacatcttccattggtgccagtacaaaaaatggccgcggtaattcacgccagaaattatctgtcataacaaatccaaatcctttcatgatgggatacagccaaaccttgatcccaaaattaaaaactgaccatgcttcttttacacttatagcatgtgtcagcacttcttatcaaacgatagtaaattttgaacatttcactttttacacgtaaaaaagtgaaaaagcaaactgaagcagaacgccttaattgagttaacgtaatagactatcgctatagttaaccccatatcgttcatttctgatcaactcagccaactccttaacctttaaaagggtttgagagagaaaaaagtgtgatgattatctacacctattttttatttatattgtggtttattaatagtagcgctgaccttcatttttcttagcggccttacttttgctctttttgaacaaaaaggattccaacctaaatagaatatcatatgagttctccctattaccaatgcaaaataattgtcctgttatcgaagagaaaatatttaacgctgcaccatatccgtatctcaatatcatttgcgaaaaaataatttgattaaacaaatggggctgggggtggtatatctgggtactcaagagaatgtaaatagaaaaagccttaacttaccgcttgtgaatcacatggagtaaagaggatgggatgggatgggaagagaaaataaactcgaacttaacagaattcaagaacttcaatctggatcttttggatttgctcatggtttagaaataaccaacgcaacaagtggcttctgtctctatacagtatatgtactaagggtcgattggctttcaaaccccatatgttaatatctttatacaatcacctatatatgtttgtataaggttacgattcagtaatcctgatccaaaaccaataaaatagactgctgactaagtgccgcagtcttcattcataagattaataagaaagtgttcattttctttcatcattaaataaggcatcagaagttattgctttcatttcgaatatcctttgttatacctgtgatgatttgtataacagtgaaaacccccaagaaaacagtgacaatattaaaccatggattatcatagaatgaaagatatgtttgaaagaaatccagttcagctatgtttgctgggaatccattcatttctctataattaggaccccatccggttaattctgcaaaattaaaataaagctgtgaaactaaaaatgccaaaaccgtgagaaaccaactttttttatacaacggccgttttttgtttactttatccatttcattatccatttccttttctgcaatactttttagccaagtgacaatctaacatcattatagtatgaagcatgattgtcgcgataattacttattaaggatataaccatcgcaggtattactgtaatagttgttatcacttgtgtttccgcctcgggtttattccttctttgggaataaggaaaataatcggggtccttttttcctgtttaggctttcatatcatgtataacgaccaaacatgcttttttagtgtgtttgatcttttatccacagttgttgctaatagtagatgtgccaactgccgttgtgattagtgtaagtaagcaaccttgccttttacagcttctgcttcagaaccttcgttcagtggttgaggttccaatatctctcattcggtttcaccttctttttatcatttattacaactatcgccaatagtagatgtgccgatgagtgtcggggactttattctttaagaaagaagtttacaaaatattaactaaaattacaagtattcacggaacttgaacgacttgttattgcttctggttcacaacaagatcttcatattttgtctgtaatgccgtttccaaacgaaaaaaagaaagtgttaatagaaagcagcctacttggctgtttttcacttgcttttccatacgtttttttcaactctttttatcagttaaataaagacaaaagacagataggacaagggcaaaacatgaaaaaacccggaaatcggaattgtttaatttaccgaaatccaggtctgattacgaattgtttattttagttagacgattttaatacaagcttcgccacggcttccacatgagccgtctgcggaaacatatcaacaggctgaatatattcgacgcgatagtccttcgacagcgtctgcaagtctttcgccagtgtggaaggattgcaggatacgtagacgaagcgtttcggttttacttttttgatggtatctaaaaatgttctgtcacagccggttctcggcgggtcgacgatgaccacgtcagggcggaagccttctttcgtccatttcgggagccagtgttcggcagttcctgtgacatatgctgcgtttttgatgccgtgttttttggcgtttttcttcgcatcgtcaattgattctttaatgacgtccatgccgcggatctcttttgcgccgcttgaaacccacatgccgatcgtaccgacgccgcaatacgcgtctacgactttttcttttcctgtcagctgagccgcttgtttcacttcgtcatacagcttgaccgtctgctcagggttgagctggaagaaggcgcgggcgctcagttcaaatgacacgtcaccgagcacttcttgaatggcatggcttccggccaacgcttttgttttgtcaccgaaaatgacggatgtgcgcgcgccgttgacgttttgaataatcgatttcacttccggcagacggttctgaatggctttgacgatttcgtctttattcggcagtgtctctttcgcggtgacaagcacgacctgcacttcgcctgtttcaaaaccgactctcgtcacgatggtgcggacatcgccttttttggtccgttcgttataaacggatacgttgtgtttttccaaaatacggcaggcgatacccgttgttttgtttgtcgccggatgctggacaatgcattccttaatcggaacgattttatgggaatcaagtccgtataagccggcaatgatgctgccgctttgcgagcgtccgacttggaactggcttttgttccggtaattccaagggttgtccattccgatcgtatctttaatgttcatttcttcgacattgaatctcgtatgacgttccagagactgaatgacgatgtcgcgtttttcgcgaagctgctgagtgtatgccagatgctgaagctgacagccgccgcactggtcgtagaccgggcatggcggcgtgacgcggtgttcagacggcttgcggatttttttgacgcgtgcttctgaaaatttcggctgcacatttgtcgcttcggcaacgacttcttccccgggcagagcgccgggaacgaagacaacttttttcttaaaatagccgacgccctctccgttaatgccgagacgtttgatggtcagcggaaatgtctgcccgattttcaattcggcaggcgcctttttttgatgttgattcacgtttttttctctccgtttctatataaagcctttctcctgggaaagcggctgatttgaaatatcacatcttttcagtataacatgcagccggcggttccttcatgtttttcactggaagtttccaaaaagctcatcattcaatacttctccacaaatataaggacgcatagcttaaatacggcgcccattcgctgcttacctggagcatcacgtcttttgacggtttatcctcaagggcgaagcggcgtttgacggcgttttgcaggccgatgtccgccaaaggaaacagattcgggcggccgaggccgaacatgaggacgttttggacggtccacgggccgatgcctctgatggcgatcagctttttcataatgtcttcatccgataaatgggtaagttccgccagattgagcgctccttctgcaatcatccgtgaaatgtcaatcgcatattccgcttttctcatgctgaactggagctcccgcaagtcctgatactcaagccccgcgatcgttttcggctcgggatagcaccagacgccgtctttttgttcaccgaaggcatggacgaaccgttccgttaaagtaaaagcgaaggacaggttgagctgctggtggatgatgcatttcatgagacagttgtagacgtcatattccaagacgagcggggttcccgcatgctcctcaaaaagcgccgacagatttgtttttgagaaatgatcaagcacaggctgaagcggctgctcccactgaaaaatgtgtttgatccgttcaatcatctcctcgcggtccgtttctccgctgacgagaaagaccgggtctgcggcggtgccttccgcttgaaccgtgatgacggacagtttgccgtcccgtgttctgagcggcactttgattgatcttgcatgaagatcgaccgcattcagcggatcgagcgacagcctttcaaggactttatcaaaatgatacggcggtgtgaccgaaaccgtttccttccacatatgctccacccctttttgtccaagtatatcatgaagcggccgggcggcaattcgtatacttttcttcataacgccgcatgatataatggcaggcggagggttgtttatgatacatataaccgcaatcacaacacataatgagatattagataatatccccctatcacgtacagaacaaccggacatcgcatggtactggattgattttttcggcgctgagatgcatgaaaccgagctgctgcgtgattattttcactttcatccgcttgcgatcgaggattgctttcagcatatgcagcggccgaaaatcgaccattatgacggctaccgtttttatgtgctccacgctctgaacccggacacactggaaatggaagaggtggacatttttcagtccgaccgtttcatcgtcagcttccatttgcacgaatcgcccggcgtctcaaaggtgagagaacggtttttcgcttctccgggattagccaaaaaagggcccgggcacatcacttatatgattatggatcagcttgtcgatgaatatttccccgtgctgtacaaaattgaagaccggctgaatgaaattgaagacagcagaacccataaatcttacggcactttaatgaatgaagtgtttgaattgcggactgatcttttgaacctgaggcggacgatcattccgatgcgcgatttaatgtaccggattttgagccttgaccatgtaaaagaaagccgtgaaacgaaagcgtatttcagcgatatttatgaccacctgttaaaactggctgagctgatcgagtcaaaccgtgatatgacgtcagatttgcgggacagctatgtgacgctgaattcaaaccggatgaacgccattatgatgacattaaccatcgtctcgaccatttttatcccgctgacgttcatcgcgggggtttacggcatgaatttcgataacatgcctgagcttcattggaaatacgggtattttatcgttttgggcgtaatggccgttcttgtggccgccatgctgttttggttcgcccgcaaaggctggtttaatattttcaagtaagaacggctgccggctgttcttttttttgagaaaacatgatagtctggaaaaaaacgtaaagaggtgtgcgccgttaccatcctttctcacaaaatcatttcttctgtcctcctggctttcagtgtcatgtccattgccccgctgtataacggccgtacggtgtctgattacatctttgagtcgctcggcttttcctcttggctggaagatggagcccatatctccgtcattcccggggtcgtgctttactttgcggcgttaatctggtgtgccgccgcgttcaggcggacgcttcccgcggcggggctgtttctgatctttctcagtatgggggccgcttccggtatcagtcctgccaccgaatatgccgttttttccttaaaacagttcgcgcccgaaaaagaggctgtcgagtatttgaagcaccgcagcgaatgcagtcatctggttgagcgaaaaagagcgggcatgagctgcacgctttatatcaatcattacggaaaaggggaacaaaccatttctgtcaccccggatttatcagaaaacataaaggacgtcacattcaaatcaaaaacgttcactgtaaaaccccgttcaaaaacaatcatcaaaacccgatttaccggattttataaggggaaagccgcctcagactccggatggtcttcagaacctgaactgaaagtggcaatcctgtacacagcagattaaccattttgcatgtataatggtggaaaacttttcattggagggactgtcaaatgaagatcgccatcgtcggactcggcaatatgggccgccccatcgccgaaaatatcatgaaagccggatacagtctgactgtatataaccggacgaaagaaaaagcggctgacctgctggataaaggggcagaatatgccgaaacgccccgacaggcagctgaacatgcggacatcgtgctgtccatgctgtcagacgatgacgccgtaatagacgtaacgttcggagcttgcggcattattgccgggttatctgaaaacggcattcatatttcaatgagcacgatcagtacggcgctgtcagaacagctttccgccgcacattcgggcagagggcagtcctttattgccgctcccgtcctcggccgccccgatgccgccgagaaggccgagcttcgcatcatcacagccggaccggcggaagcgaagaaaaaggccgaaccgctgcttaacatcctgagtcagcaagtatttgacactggtgaagaaacaaaaacggccaacgccgcgaaaatcagcgtcaatttcttgctcgtgtccatgcttgaggcgttatctgaatcgttcttaatgatggagaagtacgggttagagcaaaaacaatttttagaaatcgccggcgcgctctttggctctcccgtctatcaaaattacggcacgatcatggctgaggagaaatttgagccggccggtttcaaaatgtctttagggctgaaggataccaatctggcgctcgccgccgcagaacaggtttccgcaaaactccctcttgccgaactggccaagagccattttgaaagcgggatcgcacaaggcttcggggatctggattgggccgctttgattaaatgcctgaaataacaaaacacctctccattaccaggagaggtgttttctacaggcgcggcagcttcatttctttctcaaacatcaggtcatcaatgcttttaaacgtgtagccttcttttttcaaatcggtaatggcatcgtccagagcttctgaattgtcctttgaaacggtgtggagaaggtagatcgcgccgggatgagcctgctttatcatgtgatcataggcgtattgtttccctttttgctcgttaaccttccagtcgacaaatgcgacggaccagaaaacggtttggtagccgaggcgcttcgtttctttgaggacatattcgctgaatacgccgcgcggcggacggagatacaggttgtcccgttttccggtaatgttgtacacagcttccgtgacggaatcgagttcgtcttgaatctgatcgcccgtttttgtcgtcagatcaggatgatgaaaagaatgattgccgatgatatggccttcctttgacatccgtttaatcaaatcaggctgctctttcacaaaatgacccgtgacaaaaaaagtgcccgtgacgtgatgtttttttaacacatcaagcactttcggggtgtacccattttcatatccgttatcaaacgttaaatagatggtcttttctttcgtattgcccaaataaaaggcatcatattttttgaccagattgtccagctgtctgccggcatccggcggctgatgattgacgctgcgtttaaagccccagtttatccgttcattcggcacggcttctgcgctgttgatgcctcccgcaagtaaaacagccatgcagcaaattgaacaaaaccatttcatgaccagcactccttctgcatttttccttattttgcagtaggccctgcccttttatacagccgcattatggaaaaagaaaaaccccggcatccgccggggtttattcccaatcctttttaaagcgttcgtattttgcttccagatcatcaagcatgccgatgagccggtctatatcttcaacgtccgttgattcagggtctaatgaatcaatgacattcataaacatatcgagtctgttcttcaggtaatcgagctgctgatctttgctgtttactgcattccccatacttccactccattcattttttataatggtagcgtattttttgccgtttttcaatggttccgctacttgcgatcttggcagatcaggtctaaaattaacagttggcagacgttagtatgccccatttataaaggagttagatagtcatgacacaaaacacaacactgcgtccgatcacaccggagtacgatccttgggaagcgtacatggatgtcgaccagtatggagatatgaaactgacgaacgttgaattcacaacgacgactttgtgcaatatgagatgcgagcactgcgccgtcgggtacacgctccagccgaaagacccgaatgcgctgccgatcgaccttttattaaagcggcttgatgaaattcctctgttacgctctatcagcattacgggcggcgaaccgatgctttcgctgaaatcggtaaaggaatacgtcgtcccgcttttgaaatatgcccatgaacgcggcgtgcgcacacagatcaattcaaacctgacgcttgatatcgggcgctacgaacggattattccttatttggacgtccttcacatttctcacaactggggaacggtcgaggactttgccgacatcggatttgcaatgatggagaagaaaccgacatttgaacagcgggcgcgctattttgacaaaatgattgaaaacagccgcacgctggtcgaagcaggcgtaatggtttcagcggaaacgatgctgaacaaacggacgctgccgcatattgaacatattcatcggcaaattaccgaagaaatgaaatgccagcggcacgaagtccatccgatgtatccgagtgatttcgccagcgcgcttgaatcactcagtctgaaggacatgagacaggccattcatcatctgctcgacattcgcgatgaagagacatggatgctgttcggtacgctcccgttttacgcatgcagccctgatgaagaagaccagaagctcctccgccgcctgcgggaagcgaaaaacgttacggtgcgaaacgaccctgacggccgctcccgcctgaatgtcaacatttttgacggaaatatcattgtcacggatttcggcgatacaccgccgctcggcaatattaaaacagacagccttcccgaagcatatgacaagtggagacagacgaagctgagcaaagagctgaactgccgctgcacaaacgtccggtgcctcggcccgaacgtccttgtcaaaaacagttattatcaggacacagatttttcattacgaaaagccagaggttaacaaaagatggaaacgacaattacggacattttgaaaagcaaagtggttgagatcatcatcgtcgctctcgtgctttacgccggtgtttttctgatcaaccgctttgtccaggtgttatttaaacgcacggatttcttggaggaacggaaagggaaaacgattgaaagcctcgtccgatccatcacccagtatacggcgacgatcggttttatcttttacgtcatttctttattcgttcatgatttcggccgaattttagccggggcgggtgttgccggtatcgtcatcggtttcggcgcccagtcgttaatcaaggacatattggccggtgtctttttaatatacgaacgccagcttcataaaggtgattacgtgacgattaacaatctgttcaacggcacagtcgaagaaatcggactccgttccctccagatccgtgagtggaccggcaagctgcttaccatatctaacggtgaggtcagacagcttcaaaactataacattgattttatgcggattaccgagtccgtcgtgatcagttacaaggaagatcccgagcgggtatacgccgtgttagaaaaagcctgcgacatgctcaatgatgagcttcgcgattcactgaagcgggatgaatttctcaatgcgacggagccgtttcaagtgcatggaattatgagtctgaacaaattaaccagaggcattgaatttacagtgaaaggcatggttcaagacacagaatacttctcggcgagccttgcggtgagacgcgttcttgcccgggagctgtacaacaacaatgtgcaattgctcgaggaaatgtatcacacacaaaaaagctgattcccgaaccggaatcagctttttttatttatctcggctgcgctgtcatttgaaaaccgaatgtgacgtgatcctgcaccggaatccaagccccgattccttgcgaagtcacatttttgacgacaagtttccgcttgctgcctttcagcaccaaatacacttcaccgtatgttacttttcctttttcattaacggccggagcgtaggcgtgcaggtagccgagccgctgcggagaaattttgtaggtttgatcgcgttttgtgcctgcgccgataaccgtttcaaatgcgagcggcagttttgttttcttcatcgctttttgcatcatcatgctttttacgtcttctgcgttcggcaccttcgctgtgagcccgcctttgattttgtattgctgttcttgggcgtatgagataaccgcggtttgctgtccgccccggttatccgctctgttcgtattgatttttttatattcccagttggcgaccgtttcgttcgattgatagccgagcgcccatttcccgagaaatattgtcgcccggtatccgatggcaagcggtgaaccggaaaccgaggattcattcagcatctttatcagatgcggattttcgatgttgatctctgatgtatctaacaattccttcgccagtttgctcggctgaagcatcggctggtcctgtgaagcattcggatacgtattttcctttgaaatgcttacgacagagttgggaactttaaacggtttttttgcaccggcagacggcgttgcgaaaaaactaaaggataacagcagaatcagtgtggcatgaaacagctttctcatcatatcactctttctatagcattttcctttagtcttttcctccgcaatcgttgttatccgcattttttacaggttaaagcaggaaaaaaccgatcgccataatgacataagcggcaaggagcgtagccccttcaaaccagttcgaatcaccgtcatttgaaatcattgtcatcaaaaggacggatgagatcatcgcgacaagctcgggcaatgtgaatacaagcggcatattgaccggaaaaaagatggaacagatcacaagaaccggagccacaaacatggcgatctgcaaagtcgagcctaccgcgatttcaacggcgacatccatcttgtctttgtacgccataataatcgccgacgcatgctctgcggcatttccgacgattgcgacgataatcactccgataaacagctcgctccagccgaactgttcagccaccgcatgaaacgtatggacaaggttttcagatatgtaggcgacgataatggttgaaataaataagacggctgtcgctcttttccccgaccactcaggctgctcctcttcttcctttgcctccggctgattcggctgataaacaccgcggtgggtgacgagcttgaaataaagagctgccacgtacaaaaggatcatgatgatgctgatgccgacactcaaatcaagcttgtttttttcccccatatccatggaaaacacttcgggaatgacaaaagcaacgataatggcaaaaatcagcaggcctgaattatgccgtgcatcatgaatattgaattcctgccgcttgtatttcaaaccgccgataaaaaacgacagtcccgcgacgagcaaaagattgccgagcaccgaaccggtcagtgaagcaagcacgatgcccgttagcccttcttttaaggcgaaaagcgatataatcagctctaccgcattgccgaacgtggcattcagcagaccgccgatccgcggtcccgcgataatggcaagagattcagtcgctctccccatataacttgcaagcgcaataatcgtcaagcaataaataataaacaaaaccgctgacggccagtgcatcaggccgccgatgactgaaagcggcactcccgccgcagccgtaaagaaaaaaatccgattcatatctgcctggctccttttttcgaatgagtctttttatatccttctcaaaaactccctcaattacacttccgcggcagcccgaattggcattttcaggttgccggacgcgacaaatccgtgtacgatcaagaaagatactgacgaaggagaaaatacgcgatgtcacgactgtacttctttattttggttctgcttgtttccatctccggattttcccaaggcatgcttctgccggtgatctccgtcatttttgaaacgaacggggaatcagccgctataaacggacttcacgcaaccggcctttatatcggcgtgcttctggcgtcgccgtttatggaggccccgctgcgcaagctcggattcaaacctctgatggtcatgggcggatttcttgttatcatcagcttattcagttttatttggcttcaatccatatggttatggttttttcttcggctgcttatcggaatcggggatcatatgctgcatttttcaacccaaacgtgggtgacgtcaaagtcaacgccccgaaacagaggaagaaacatttcgctgtacggactgtccttcgggctcggattcgctgtcggcccgttcatggtccctcttgtgaaaacaagtccgtcccttccgtttatcgtatccggctgtatcagtcttgccgcctggctgtttgtatttgtcttacgtaacgagtacccggcgcaaggtccggatgaaacatccggggacaacagcgcaaaacggttttaccgcgcccttcttttcggctgggtcgcttttctcccggctttcgggtacggttttttagaaacggcgctgaacggaagctttcccgtgtacgccctgcgcttaggtatatccgtcgatgccgtcgcgctgatattgcccgcttttgccatcggaagtattgtattccagttccctctcggtttattaagcgatcgattcgggagaaaacgtgtcctgctcgtcatcttattaacgggtgccctttgctttttgacggccggactgtttccgtcgccttctgtcatcggctgctgctttttcacggcgggaatggcggtcggcagtatgttttccctcggcatcagctatatgagcgacctgctgccgtcccatctgctgcctgcgggcaatctgctctgcggcatttccttcagcctcggcagtatgatcggcccggtggcgggcggctggtatatgcagcggtttgaaaacgccaatttgttttactttattacggtgattctggtctgtatttggcttgcgctcgtcttcgggaaaacaaagcacagtcccgcatccgaatcccattcttttccggcctcataaaaaagccgcctgatctaagtcaggcggcttctttctagtggtatccgttctgcccgttagcgcttccgcttgttttattcttcgggccgtttttggagttttgtttattatggcttccgccttttttcgtatgcttggtcataatcgattcccctccgtttttcagcttgaacgtcatccgttcctctatagcttgctcccgcggtacggattttcatcaggaagctttttacgtttatgtaaaagcgcgttgatttctcctcctaaaatcagcagtgttcccgtaaggtaaaaccagatcataaggacgataattcccccgatgctcccgtatgtggcgctgtagttggcaaaggtgccgacgtaaaatgagaacagcatactgacgataatccagcctgctgccgcaaatacggctcccggcagcacaaaacggagggaaagccttttattcggcgcgaaaatgtaaagcgcggtaaacacgattaaaaggataagcggactgataccccagcggacaaccgaccacacctgcaaaaacaggccggaggcgccgatgaaatctgcggcaagcattccgatttctctgccgaacaccggcagaagcaatgcgattaaaatcgtaaccaccatcgcgatggttaaaaaaattgaggtcaggcgaataatgataaatgagcggttttcctcgacttcgtaggcatggttaaatgctctgacaatcgcgttcataccattcgaagccgaccagatgacggcgataatcccgaatgacaaaagcccgccgctgcgcttgttcagcgtttgctccgttatggatttcaccatagacatggcactgtcgggcgcgtattgatcgaccgccccgagcacgtcttctgccgatatgggaagataggcggtgagcgtcagcatgaaaatcatcaacggaaacaatgacagcaggaaaaaatacgccagctccgccgatttactttgtccttcatggagagaaaaccttgcaaacagctcctttataaaactcatgacatcccacctcaatgatcgtttttcgaaaaatgctccttcgtttcttttaacaggtcaatgacctgcggcgtcgtctgcttcagcttggtgatctgcccgtttaaaaaactcagatcttccgatacggtattggcgatgattttcacttgatcaagttttgcagaagcctgctgtttcagggcttcaggatgttttcgataaaatgccgcacgccgcctgcacgcgtccatgttccggaaacatgcctctctcgtcggcttatgtaataaggacagtgctccgccggcggcagcgccgatcagaatcgcttttgccatgatgcgtgtctgcttcatcggtcaatcccccttataaatgatggtctttctttattgtctccagcaaatgacggcacccggactcgaccaaagcgtacacctcgctgaaattcccggtataatacggatcgggcacgtccgcaaggtccgactccggtacataatcaagcagccttgcaatacgcggcgccgcttttttataaccggccatgctgcgcagatgtccgatattttctgcatccatcgcaatgacgtaatcaaaatcggtcagatcagactcacgcacctgcctcgccgtgatgccgcttacgctgatccctttcttctttaggatctcctttgtcccttcatgcggcggatttcccgcatgccaggcgccgattcccgctgaatcaatgttaatctgcccgttcagcccgtttttcttcaccatatcagaaaataccgcctctgccataggcgaccggcaaatatttccaagacagacaaacagcacatgtatcatatcgataacctccctattctttccccgcattttgaggatcaaaaaccttatcatcatcttagcaacttttctgctgctgtggaaataagcttttattctaaatgaattctgttagaataaagggtacgaaaacggtcatgaaaggatgcatgaatttgccgagccaacaaacagaaacgttaaacaaaatgattgaagacatttcgcaaaagctcaacatgctcaatgtcggcgtcatcagagcggaagatttcagtgatgaaaaaatagaagatcttacataccttcatcaaatggtcatgaaaaaagcatcattcagcccgagtgaaatgcaggccattgccgaggagctcgcctctctcagaaaataaacccgtgtcagacctgccgaaaaacggcgggtctttttttgatttaaaaaagtaaaaaataaaagttcatcggtttgacacatataaaaagaaggagtatagtaactgtgaacttggtagaacgatatactaaatgagcgggccgcttatctttttttatttagtagaacgatatactcgttgtgatatcagcgttattcaagttttgtatctgcaaccgttttatcaaaccagttttcaaagaaaggcagtggttcaataaaggggaatggttctgtgcttttgttaatttaaaaattaatttaattctttattaaccgcattaggggatgtcatcatgaaaaacatatacaccaaaatggcagcgggtctttatattaattatttcctgctgggcatgatcaatattattatcgcatccaatatggaggcattatcaaaacagcttcatacatccgcagccggggtcagctatttggtctccgccatcgggatcgggaagctgatttcgcttctgtttgccgggaagctttcggatacattcgggagacggccgtttatcgtgtcgggcgcctttctgtatctgattttcctaatcggaattccgctttcgacaaactatacggccgcgtttatcttcgccattttcgcagggatcgccaattccttcttggattccgggacatatccggcgcttattgaaggatttccgaaaaacgcaagctctgcaaccgtgttaatcaaagcgtttgtatccatcggcgcgacggtgcttccgtttttcatcgcgtttattgcggacaggcatttgttttacggctggacgtttttcgtaccgggcattattttcttcctgaacggctttttcctgttaaaagttccgtttccgaatcataagcaaaaagaagacggcggccggacggaagcctctccgtctgatgacgcgttcacatcacagccgtcgatatggcgcgaaggtcttgcgatcattctgttaggcttttcatctacggcgctgtttatgctcgttcaagtatggcttcctaagttcgggcaaaccgttttgggcatgcctgaggtgcaggctgtcaaattgctgagctattacagcatcggtgcgcttgtgtccgtattattgctggccgtgctgttaaacagagtgattcagccgattacggtaatggtgctgtaccctgtgatcgcggcaatcgcgctgcttgctctgattttcattcatcagccggccgtatcagtcatcagctcctttgtcatcggactttcaactgcgggcattctgcaattggcgatgacggttatggctgttttattccctaaaaataaaggtacgatcacatcttttgttaatatagcatcaagcttatcttttattgtcattccgcttgtaacgggagcgatctccaaagcggccggcctgacgcctgtttttctgcttgatatcggaattgcggccgtcagcgcccttctcgcattgtttatcggaatccgctttaagcaagtgatgaaagcctgactattttttaagggagaggatttatcatgcaatctatcacgatcagaaacacggtcatcggcgaagggcttccgaagatcattgtgccgctgatggcggccggagagaaagaactgctcgaagaaattgaagccgtcaacaggcttcgcccggatatcattgagtggcgggcggatgtgtacgagcacgttgacagcctggacgccgtaaaaggcatgcttgaaaagctgcggaaagccgcaggcgcaacaccgctgcttttcacattcagaactcataaagaaggcggaaataaagttattgatgaccgcttttacattgaattgcttaaaaccgccatcgaaacaaaacacattgaccttgcagacgttgagttgtttacgggagaagcggaagtcaaatcaattgtgaaaaccgctgaagacaacggcgtatatgtcgtcatgtccaatcatgattttcatcagacaccgaaaaaagaagaaatcatttcccggctgcggaacatgcaggcgtacggcgcgcacattccgaaaatcgcggtgatgccgcaaagcactgaagatgttttcgtcttattggatgccactcacacgatgaaaacacaatacgcagaccggccgatcatcacgatgtcaatggcgggaacaggtctgatcagccgcctggccggcgaggtcttcggctcagcgtgcacgttcggagcgggcaaagaagcatcagcgcccggacaaattcccgttgaagaattgcgcagcgtactcagcattttaaataaacatatgtaatcagcgtttttctgcccttaaagcgggatgaaaaacaaatgaatggactaacggaggaatacatcatgaagaaagatttaggacggattaacggaaaaactcagcttatcggattattcgcgacaccgatcggacactctttatctccggcgatgcacaacctggcgtttaaaaaattaggattgaactacgcatacctcgcgtttgaagtcggcaatgaacagctggaagatgtggtaacgggaatgcgcgccttaaacgtcagaggcttcaatgtctcgatgccgaacaagatgaacattctcccttacctcgatgaactcgcggattcagcgaaattcaccggcgcggtaaatacagtcgttaatgaaaacggcagactgatcggacactccactgacggtatgggatacgtccgcaacttaaaagaacacggcatcgatatcacgggcaaaaaaatgacgctggtcggttccggcggggccgccactccgatagcgattcaatccgcattggaaggcctcggagaaatctctattttcgcccgcaatgacgcgtttttcgaaaaagcggaagaaaacgtccgcatcatcaatgaagaaatgaagggatcttcttgcaaagcgaaagtcttcccgctcgaagatcaagatgcgctgcgtgctgaaatcgcttcaagcgatattttcacaaacggaacgggtgtcggcatgaaaccgcttgaaggcttgagcgtcattgaagatacatccatgctccgtccggatttgattgtgacagacgtcgtttacaaccccgttacgtcgaaattgcttgaacaagctcaagcggccggctgcaacaccattaacggcctcggcatgatgctttggcagggcgccatggcgtttgaatattggacaggccgtgaaatgccggttcagtatattaaagagcaaatgtttgaataacctattgtgacagaagcgccgaaggacaatccgtcttccggcgctttatcattttctccccctctctctttcttctcatgcgccaaaacgcttataatggatgtaacgaataaaaaccaagtgaggaatgcgacgtatgaaacagcaaaaaaaacgccgggtgacattgcagcaggtcgctgaacatgccggcgtctcaacatccaccgcttcattaatcgtccgcaataatccgcgaatttccgaagcgacccgtgagaaagtgctgcaatccatgcgggagctggggtacgtatatgatcgggtcgccgcgaatttacgatcacagacgtccacaacggtaggattgattattactgacatttccaatacgtttttctcagagtttctgatcggcgttcagaatacgcttgaggaagtcggattaacggtgctgttaggcacgacatttgattccgtcgcgaagcaggagcagctgatctcgaccatgctggagcacagggtcggcggattgattttgtgtccggtttcaggtacggctgaggaaaccctttcccgccttgagcagcttgacattccggtcgtgctcgccgtcagggagattgccgatgccgactgtgattttgtcggagccgattatgaggaaggcacctataaggcagtgcgtcatttcattgagaaaggccatcaggagattgcgtttctgggcggcgtgaagcactcgtcaacatggacgaagcgcatgaaagggtttaaaaaagcgctccgtgaagcggatctggaagtaaaaaatgactatgtcattgacagcgcgccgacccgcgaagcaggctgtgaagccgtgacggagctcctccgccggtctgagcgcccgaccgcgattttctgcttcagtgatttggtcgcgttcggcgtcatgcaagggatcagaaaagccgggctcattccgggcgaagatattgacattgtcggctttgataacgtgccggaagctgaaatttcttatcccccgcttacaaccgtttcttcctttccgcggcagtcgggaaaagaagcggctcaattgctgcatcataaaatcaccagttcccagcacaaaaaacaacgcattattctggcgcctgagctggttatccgggaatcttcacaaaaaaagcggaacgcctgatacggcgctccgcttttatattacgcaagcagttttaatgattcgcggttgaatgccggtatgtcatccggtgtgcggcttgtgaccagctggttctggcagacgacgacttcttcatccacaacattcgcgcccgcgttttccatgtcgattcggattgatgtaaaccctgtcgctttgcgcccgtccaatgctttcgcgttgatgagaagctgaggtccgtggcagatggcgaacaccggttttttatcatccataaacgctttggcaaattggacgaaacgatcatccgcacgcagcatatcaggcgagaatccgcccgggatcagcaatgcgtcaaagtctttcggattcacatcatcgatggacgcatccactttcacttccgcttccccttgtttgcctttgactgtttttcctttttcctgttcaattacggttaattcatgacctgcatctttaaaagctttcgcaggttcagtatactcgacatcctcaaaataatccgttaatacaactgcaatttttttacccatagttactacctcctgcttgatgaagtctacataaatccatgtaccccagccacactaacatcaaacataggtaacgcgtttgccgctcatccgttttacataggtcattatcctcatttttcatctttttacaagaatcatcatgaaatctatatgaactttcacaaaatattcttacaatggtactgcatgacaaaatttgttgaaaggtggagaacaggtgagaatacagaaaagacgatgcagcgtcaatatgacactccgtattctgctgcccctagttatgatacttagtctaatcctcccaacatcacccattaaagcagaagaaaacaaatcctccagtgtgaatctcagcattttagccacaactgacgttcacgctaacatgatggactacgattactacagcgacaaaccgacaacggaattcgggctggcccgaacggctcagcttattgagaagcacaggcgcgaaaacccgaatacgctgcttgtcgataacggagacctgattcaggggaatcccctcggagaatacgccgtaaaatatgagaaaaatgatattatttcaggcgcaaagacccatccgatcattgaagtgatgaacagtctgcattatgacgcaggaacactcggcaatcatgaatttaattatgggcttgaatttctggacgggacaatcaaaggcgctgattatccgatcgttaacgccaatgtgaaaacattaagcggcgaaaaccgttatacgccttatgtcataaaagacaaaaccgtcacggatgaaaacggcggcaagcatcagataaaagtcggctacatcggctttgttcctccccaaatcatgacgtgggataagaaaaatctcgaaggccgcgttcaggtcgaagacattgtggaatccgcaaagaaaaccgttccgaaaatgaaagctgaaggagccgatatcgtcatcgccctcgcccacagcggcatcgaaaaaaaagcgcagtcttccggagcggaaaacgccgtttttgacctggcaacgaaagtcagcggaattgatgcgatcgtatccggccatcagcacgggcttttccctgatgccgaatacaaaggcgctgatcaatttgacgtcgataaaggcacgattaacggcatccccgttgtcatgtcaagcagctggggcaaatatgcgggcgtcatcgacctccggcttgaaaaaacagacagcgcgtggcatgtggaagatgcaaaaggcagcatcgagccgattgccggcaatgtgacgtcggaaaacgaaaccgtcgtcaataccgtcaaaaaagcgcacgaaggcacattgaaatacatcagagaacccgtcggccagacaaaagccgatatcaacagtttcttcgcccaagtcaaagatgatccgtccattcaaatcgtaacggatgcgcaaaaatggtacgccgaaaataagatgaaggatacggaatacaaagatctgcctatcctctcggcgggcgccccgtttaaagccggcgggcggaacggctcaaactactatacaaacatttccgctggcgacctcgccatcaaaaatatcggcgatttgtacctgtatgacaacacggttcagatcgtcaagctgaacggaagcgaagtgaaggactggctcgaaatgtccgcagggcaatttaatcagatcgatcaggcaaaaggcggcagccaagcgcttttaaatgacgcctaccgctcatacaattttgatgtcattgacggtgtcacctatcaggtcgatgtcacaaaaccggcgaaatacaacgaaaacggaacagtcattcatcccgatgcaagccggatcgtcaacctttcttatcaaggaaagcccgtcagcgccaagcaggaatttctgatcgtcacaaataattaccgcgcttcaggcggcggaggattccctcacttaagcaatgataaaatcgtatactcttctgccgatgagaacaggcaggtcttaatggattacatcatccagcagaaaacgattaatccgcaggctgatcataactggtccatccttccggtcaaaggggcaaacatgacatttgaatcttccttggccgcaaagccgtttgccgaccgcgcagatgacgtcgcctatatcggtgaatcacaaaacgcgggctacggacagtacaagctccaattcaaagatgatgaaccgggcacagatccgccgaaagatgacgcatggaaactcaccgttatgcatacaaacgacacgcacgcccaccttgataacgcggcgaggcggatgacgaaaatcaaagaaatcagaagcgaaaccgaccgcagcattttgctggatgcgggagacgttttctcaggcgatctctatttcacaaagtggcaggggctggctgatttaaaattgatgaacagcatgggttacgacgcaatgactttcggaaatcatgagtttgataaaggcccgggtgctctcgccagcttcctgagcgggaacggaagcgcggctgacccgtccggaaaatacaattttcaagcgcctgactttccgctcgtcagctcaaatgtcgatgtgtccaaagagtcaaaactcagaccattcatgaaaaaagcagacacatttacggcagggaaaaagaaaaaagcaggcatctatccatacattctgcttgatgtaaacggagaaaaagtcgccgtattcggcttaacgacagaagatacgtccgtcacatcaagcccgggaaaaagcattgtctttcatgatgccttccaatccgcacaagatacagtaaaagaaatacagaataatgaacatgtcaataaaattatcgccctgacccatatcgggcatcagcgtgatctcgatcttgccaaaaaggtaaaaggcatcgacttgatcgtcggcggacatacgcatacgcttgtagataaaatggaagttgtcaaaaacgaagagccgaccatcgtcgcccaggcaaaagaatatggcgaatatttaggccgtgtcgatgtcgcatttgacaaaaacggcgtcgttctgccggaacaatcctctcttcaggcgattccagtgaacgagcagacgaaagaagacccggatctgaaaaaagagcttgatccgtttaaaaaagagctcgtctcagtcaaaaatgaaaaagtcggctcaacgaaggtcgcacttgacggccagcgcgagcatgtccgctccaaagaaaccaatctcggaaacttcatcgcggacggcatgctgcaaaaagcgaaggaagcggccggcgcccaaatcgcgatcacaaacgggggcggcatccgcgcgggcattgataaaggagacatcacactcggcgatgtgctgaatgtgatgccgttcggcaacacgctttacgtcgcggatttaaccggaaaacagatcaaacaagccttggaacaagggttaagcggaattgaggctcaaggcggcgccttccctcaagttgccggtttaacatacacgtttacactgaataaaaagccgggacaccgcgttcttcaagctgcggccgtacaggatgacggcagcgtaaagccgatttctgataagaagacatacagagtcgccaccagtaactttgtcggtgaaggcggagacggatattccgtctttaacgaagcgtcccataaagaagaccttggctttgtcgactatgaggtcttcaccgagcagcttgaaaaagcgggaaaagcggtggaaccgaaagttgacggccgcgcgcaggaagtgtatctgccgacgaaacaaaaaaacggttcgtggacgcttgaagatgacagcgcatttgccgtttatgccaaaaacgccaacacgccgatcgtgtattacgataagaatgacggcgccaaaaagccgattgatctcagcgtgaccaaaaaacaaatcggcctgttaaaggacagaacatcggattcttcccttacgatcctgcatgacaagttcagcatgaaaatgccgatggcaaacgctgcttcagctgatacacgattcggcgtgacgccgaaaggaaaagtaagcggggcgctttcaaatgtatacgactttacaatgaagcagaaaaacaaagacatcaaaacattcaaagcgccggtaaagctcaccctgcgcattgagaatacgaaaaaggcgaaacagccgggcatttaccatgtagaccggaaaaagaacgtctatacaaaaacagacaacggttcggtttcacacgatctcgtcacgggctatacaaatcatttcagtgaatacaccatattaaacgcaaacacgaagagcgcgccgccgacaagcggagaccacggctccggaaagcagccaagcggacaaaaaccgtcatccggccctgcacaggacggagtatcgccgggcggcctgcttcctgatacggccacaacgatgtattccatccttcttgccgggtttctcatcagcgcgctcggaacggcactgtatctgcatcaaagaagaaaagcaaaaaaagtgaacgaagcataaaaagaccgcttttatcgggcggttcatccaaaagctctcctgatctgatttcaggggagctttttctctcggtccccctctgagtcgacagccgtacggccgagtgataaaatatgaacgttattcgcgaaagactgcatccgcatcgtttaacacttcacggcagggcctctctttcatacggcgccgcctgtttggaggactttttttgaagataacaggacacaaacgaaaccgcatgtcttacaagaaaaagctgttttacgtgataacagcgctctgttttatcagctcgctcattttcgtcactcacaacgcttctttttatgagcggccgattgccaaagtgacgaaaacaacattggaacatcagtctgacgtacaggacatgcataaaaacaaagataagattttcaatcagacgatcactgccagacttgaaaacggcagtcagaaaggacagctcattcatttgtccaatcagtattcatcatccggagcgaatgatcagaaatattcgattggagatgaagtattcgtttctattgataaagggaaaccatcaaacaaggatatatcgggaagcattatagataaaaaacgggataagcagcttttgctgatcgcttgggttttcatcttcaccttgcttatcgtcggcaaaaaacaaggcttcttttcgatcgtcagcctgatgtttaacgccgttttactgtcgtttgcattagatttgtacaggaagcatcctaatatagggttaattttcatctgcggtgtctgtattctcatctttactgtcatctcattgctgcttgtcagcggttttcacgcgaaaacatatgcagccattgccgcgacgctcgcaggcactttcgtttccctgctgattacgtatctggtgatgctggcaaccggtgagaaaggtctcagatatgaggaaatgcagtatttaacccgcccttatcacacggtgttcatggccggggtatttatcggatcactgggagcggtcatggatgtagccattaccatgacgtcatctgtcttcggattatatgaagaaaacaagggaatctcattacaagctctcagacgttccgggatggagatcggaaaagacatcatgggggcgatgaccaacattctgttttttgcttatataagcggctctattccgatgatgctgttgtatttgaaaaatgattccccgataggattcactctttctatgaacatttccttggaaatagccagagcattggccggagggatcggaatcgtattagccatacccgccagtctgtatgcttctatcttttttattaaacgaaagaaggcaagctcatgaatgtcatcgtaattctcgcggcgattttatttctattgatggtcatcatcggcggaaaaaaaggagcgaggtcttttattgcgttattcttaaatttcggtgttctctttctcaccatcattttcatgacagacccgcatatcaatccgattgttttaacattgctctcttccgccgtgatttgcagcattactcttttttatattaatggaggaaacgtcaaaaccgtaaccgcctttatttctgcaatgctgacgattgtactgctgctgttttttattatgtctgtaacaaaacatacttcgattcagggattcggtgaagaagaattgggtgatatcggcatattcacactgtttgtcggggtggattttgtgaaggttaccgcagccatgatcatcatgggcacgataggggcgattaccgatgtcgcgatttcaattacttcacccatgcgggaaatttacagtcataatccgtccatgagcagaaaagatctgtacacattcggattaagcatcgggagagatattttaggaacgaatacgaatacgttattctttgcttttttcggcagctatttggctttaattatctggtttaaagacttatcatactcagctgaaaaaatagtgaactcaaaagtattcagtgcggaagccgtcaccattctttgtgccggaatcgggatcggcatcatcattcccgttacatcctggatcaccgcctgttttttagcaaaaccgaataaacgttaaaagctgccgggacacgcccggcagctttttttatcttatacccactttacaacgtcttttgaggcagatcttgttttcgggcgcggttctctgacacggtagccgaatgcggccataacagagatgtcgaaacttccgttttccagaagcccttcttcttcaagaatccggtgaatttctttgtagttgaagccttctacagggcaggagtcgattccgatctgcgcagcggctgtcatcatattgccgagggcgatgtaagtctgtttggatgcccagtcaaacagcgcgcgatctgattctagcagattgaaatcatttttctggaagtcttccgttttgctgatatagccttcatacatatcttccggcatttttttgacttcccgcaagtggtttttgacatagtcggcgtcaaaacggatatcctttgccgtccgggcaagcagaagtacgaaatggcttgcggtcggcagctgcttttgcgcgccccaagtgaactcgcggagtttttcacgaagctccggattttgaacgacgacaaatttccaaggctccaaaccgagtgagcttggggataatcttcccgtttctaaaatgaattcaaaatcgctttctgaaatttttttctcaggatcaaattcctttgtggcgtgtctgaattgatacgcttcgatgatctgctgttttttatctgacattcatgatctctccttttcaatcgttatgtactattgtagccattatttttgaaagtaccagtacgcacatttttgtgggatagtattcattttgatactgacaaaaaaacgggctgccgcggcagtccgtttttatttttctcttctcgcaaagtcgacgaaacggaatttatcgagcctgtgccggctttccgtgtactgaaagaggctggtatcctccaaaaagacgcggtttttcacgaccgccatatggctgaacccgcctagatccaaatacttccggtcctcctcccccgccggctccacgacaatttccttttgcgcgtagctgatggagaggccaagttctccttcgagatactcatagatcgaatcttcacaaatcgccttcgtcaatagaggcacatgttttttcacaaagtaatccttgtccaaaataatatgttctccgtcaatccgtcttgatctgacgacttcccacaccttttcatccgcttctgtaccaagctcttttgcggcttctgagggaggcaggatcagcccgagacggtgaaccgtcgttctcgtctcttttccgagcgtttccgaaacctctttgaagctgatcaggcctgagacgggaaaacgcattttttctctgtctaatatgacggagcctttgcctttgattttctggatgtagccgttttgcgccagcatattgagcgctttgcggacggtttctcgtgatgtgccgtattgatcgcacaaatcattttcagacggaagaacgtcttcagcctgccgctggccactttcgatctgccgcaccatatctttatagattgtgatgtatttattcactttcatttgaccacccagattagtgtatcacgcttttgtcagatgataaacgatcgattcatacggacggagcgtcaatcgttccggccgcccttccctcggttcatcattcgtcagcagcaccgtaaaccgccagccgtccgtgtctttaagcggaaccgtaaagtccgcttctttcccgtagaagttgttgatgcacagcagtttttcatccttgccgtgtctgacgtacgccagaaccgccggatcgtcttcagcaagcagctcaaacgttccttcagtcacgatgtcatattcttttctgagcttgatgagcttctgataatggtagaaaattgaatccaggtcccgcaaagccgcttccgcgttaacgtcccgataatcatccgccgccggaatccaaggcgtgcccgtcgtgaaaccgccgtgcggcccgctgttccactgaatgggggttcttgcattgtctcttgatttctcttttaaaatggcgataatgtctttttcgggcacgccttcttccttcatctttttgtaaatattcaatgattcgacatcgcggtatgagccgatatcatcgaatttcggattgcccatgccgatctcttcaccttgataaatgtaaggcgtgccctgcatcatatgaatggccgccgccagcattttggctgatttcgtccggtatacgccgtcgtctccgtatctggatacggcccgcggctggtcatggttgcaccagaataatgcgttccagcctccgcctttttgcatctccgtctgccaaaacgctaaaatccgtttcagcttcagaaaatcaaacggagcgagcgcccatttttcaccattcggataatccacttttaaatggtgaaagttaaaagtcatatcgagttctttattctcagggtttgtgtaccggatgcagtggtcagccgttgtcgaggacatttcaccgaccgtcatgctgtcatatttcgaaaacacttcccggttcatctcatggagaaattcgtgcacgcgcggcccgtccgtataataagggcgcccgtcacgcccatcctcggcatcaggaaacgattggtctttagaaatgaggttgatcacatccagccggaaaccgtcgattccttttcggaaccaaaaatgcatcatgtcgtaaacctcttttctcatctcttcattttcccagttcaaatcggcctgcgacacatcaaataaatgcagatagtgctggcctgacgccaggtcgagctcccaagcggaaccgccgaattttgattcccagttgttcggcgcccggccgtcttcctttccgtctttccaaatgtaaaaatcccgatacggactgtcgggtgacgagaccgcttctttgaaccaccgatgctcgactgatgtatggttgacgacaagatccataacgaccttgattcctcttttgtgcgcttcatcgagaaggcgttcaaaatcctccatcgttccgtactcttcataaacggtgcagtaatcgcgaatgtcataaccgttgtcattctgcggcgaatcgtaaatcggcgtaagccaaatgacatcaatcaaaagcttctgcaaataatcaagcttctcgataataccgttcagatcaccgatcccgtttcccgtcgtatcattaaagctcttcggataaatttgatataccgctgcctttttccaccatggtgtgctgtctgttttcatttttcttcaccgcctgtaatgttttgaattgaaagggaaaagggacagcctgatagaaggcgccccgcaggttttctatttttgccgtttcagccgcgcatacccgtatgttcccgcaaacgggagaatcagcacgatcagcattccgatcgcaaacggaccccagtaccggctcataatggagaagatccccggcacgccgccgactccgaccgagcttgcgagaacgcctttgacggagatgaacatccccgcgattcccgaactgatcatggcgatcacaaacggaaatttgtaacgcagattcacgccgaaaatcgccggttcggtaatgcccaaatatgcggaaatgccggccgtcagtgaaagcccccgctgttttttatcttttgtaatcagcatcatggccaaagccgccgatccttgagcgatatttgacaatgcgagcatcggccataaaaatgtgccgccgagctttgatccgattaattgaagatcgaccgcgagaaacgtatggtgcatccccgtgatcacaagcgccgaatacagccctccgtacagcaggcctccgatggcggagaattgtccgaaaacggcaatcaatcccaccgtcagcgcgttaccgatcgcaaaggtaatcggaccgatgatgacaaaggatagaaaaccgatgaccaaaagcgtcaccggcgcgacgaccaacagctgaatgccctccggcgtccgtttcgtcaaaaagagctcaagcctggcaagtaaataagacgccagcaggatcgggagcacctgaccttgatatccgactttctgcacctcaaggccgaacaggttccacaccggaatatcgccgctctgctcggcagccccgtagccccatgcgtttaacagatcaggatgcaccaacatcagcccgagcacgatacccaagagcgggcttcctccgaaccgcttcactgccgaccagccgattaaagccggcagaaaagcgaaggccgtccccgcgatcagattaatcatattggcgagatccgcccattgcggatacacttggacaatcgatttggcgctgtagaaaatgccttccgccgttaatatattgttcagacccattaacagcccggccgtgacgatcgccggcaagatcggaataaagatgtccgcaagcgttttcacagcacgctgtaaaggattcatgttttgcgccgccgccttcttcacgtcatccttggacgcttcacccatccccgtttccttcactaattccgcatatactttgttgaccgtcccctgcccgatcacgacttgaaactgcccgtttaccgcaaaagatcctttgacaatgtctattgcatcaagcattttttggtttactttggtttcatctattaatgcaaaccgcaaacgcgtcacacaatgagtcgccgcctcaatattttcgattccgccgacagcttcagcgatctgccgcgcagcccggttaaactcacccatgccatcccctccgtaaccgttttcattttgtcttgcaaacttgtatatacatgtttatgactctattgtaatgatgtatatacatgtcgtcaatctatttttatagcgctttcatcacaaatatactgcgaaagaccctgaaacaaaaaaagccccgccggaaccgggccttgacttcttgtttatcgggaacatgtccgggcggaattcacaacaggagcacaaaaagcatacagtactgtacaactaagttaaagaggtgtgaagagatgccatccactgttatcaacctgtactatttgaagattaacagtatttctggcaacggatctattacgattggggaagcggcatacaacagtcccaccacaaataacaaatcacaaggactgaactcttcattcggcgatacgtcacctatagaatcgatgatggagaacttgttaaatgatcctgatgtcaacgaccagacagccatcggaaccgcagataccgcaaatattacgccggtgccgcccattatagattaaaggggtttttatgaatgccttaccaaattaacgtcgtcaatataaaagtaaacggagcaacgcaaaacggaaacgtcgatatcggtcagaccgtacaaaacagccacaccgccaacagcaaatttgtcggcgcgaacttttctttaggggatttttcgccggccgccggatgtttgaattcgggccatcttgaccctgacgtgagcgatcaggatcagatcgccaacccgtcaatgccgatcgcaaatcaaatatagggaggttctgccgaagtggatatcgagaaaatgagaaagtggcttgagattacgaacgagcacaagcccagcgaattttggaccaatgtcctgaaacggaaatctctcgaagattttttctccttacaaaaaaacaccctgacttatgatatttatcaggatgaacagcacacatttgtcattgtggaaatgcccggcgtttacgaagaagaattgacattgaggctgctgtcaagaacacggctgcatataagaggaaacatcacacccctttttccaaagaacatgggcgtctgccaaaaccggtattacggggaaatcgatgagacgattgagcttcctgaaccggctgagccccacctgttacaggcgcagtgcgtaaacggcctgctccacatttcctacccgcgccttatggagcacattccttttcagaaaaaaatctaaagagccggcttacgggcggcccagccgtctgtacactttctccttataatgagaagatacgggttttgagaacatggctttctcctccgtcagtttgtcgagtctgacttgtttttccgtccgtttgttccgcaggtgatcccgctcctgttcattgcggcacttggcgatcaaataatcgagcgtcatcagctctttcttcagcgcgccctcatcctcggcgatcccggcgttttttaatatgcggtagcccattctgagcgactccggaagatgtgcggcatcgtctttcggcaggggctttcccattcctttgatgccggcgaactctccatccttaatggcgcgcttgattttatcttcagccacgatatgggcaatatccatcactgttcacctcttttttcaatagaaccgggtatgatcatacggaaacacaaatcccagtttgtgccatttatatgttttaaagctgtcattcaacagatcaaccgccgttgcgacagcgtttttcgccctttttccgatgagccttttccaccttttctatttgctggtttcatggtatattgattacgttcgttttttctatcgttccgtgtaaaccgtgatcggaaaaaaggagtgtaacaatgaaaacatttataaaagaaagaggacttgccttcttcttgatagcggtcgtgttattgtgggtgaaaacatatgtcgcttatattttaaactttaacctcggcatagacaacacgatccagaaaatattgctttttgtgaatccgctgagctccagcttgttctttcttggatttgggcttcttttcaagaaaaaattacagcagacagccattattgtgattcattttttattgtcttttttgctttttgcaaacatcgtctattatagattctttaatgatttcattaccatcccggtcatgatgcaggcaaagacaaacggcggccagctcggagacagcgcgttctcgttaatgagatggacagacgccttctacttcctggataccgtcattttgattattttggcccttaagatgaaaaaaccggctgaaaaaccggcgaagaaatcattcagaatcgttttggcttccgccgtgcttatgttcctgatcaacctcgccgtcgcggaatccgaccgtcctgagcttttgacacgctcatttgaccgaaactatctggtgaaatacttgggcacgtacaactttacgatttacgatgccgtgcagaatgtgaaatcaaacagccagcgcgcgcttgccgattcaagcgatgtaacggatgtagaaaactatatgaaggccaactatgacgtgccgaacaacgtctacttcggaaaagccgaaggaaaaaacgtcatctacgtctcattagagtctctgcaatcctttatcattgattacaaaattaacggcaaggaagtgacgccgtttttaaacaaactggcgcacgataatcaaacattctactttgataactttttccaccaaacgggacaaggtaaaacatctgatgcggaatttatgatggagaactctctgtacccgctttcgcaaggttcggttttcgtcaataaagcgcaaaacacgctgcagtccgttcctgcgatcttaaaaggcaaaaagtacacgtctgccgctttccacggaaatacgcagactttctggaaccgtaacgaaatgtacaaagcggaaggcatcgataagtttttcgattccgcttattatgacatgagcgaagaaaacacgaaaaactacggcatgaaagacaaaccgtatttcaaagaatccatgccgctcttaaagagcctgccgcagccgttctatacgaagttcattacgctgtccaaccacttcccgttcggaatggataaagaagacacggacttcccggcgggagactttggcgattcagtcgtcaataactacttccagtccgcgaactatctggatgaatcaattgaacagttctttcatgacctgaaaaaagacggcctgtacgataagtcgattatcgtgatgtacggagaccactacggcatctccgaaaaccataataaagcgatggcgaaagtgctcggcaaagatgagatcactgaatacgacaatgcccagcttcagcgggtgccgctctttatccacgctcccggcgtgaaaggcggccgcaatcacaaatttgccggtgaagtcgatgtcgcgccgaccgttcttcatctgctcggcgtcgatacgaaagattatctcatgtcaggttcagatatcttatcgaaagagcacagagaagtcattccgttccgtaacggagacttcatctcaccgaactatacgaaagtgtccggcaagtattacgatacgaaaaccggaagacttttagatgattcagaagtcgacaaaaaagaagactctctcgtcaagactgagcttgaaatgtctgataagatcatcaacggcgatctgcttcgtttctatcagccgaaaggctttaagaaagtggacccttcacaatttgattatacgaagcgtgaagattcctcagcagatgatcaaaaagaataaacaaaagccagatcatatcaatgatctggcttttttatgttcagctcccggcggcggccatagagcgcttttgcaggctgtcggaaagaactgaataagcgacgactttctttttctgctgtttgacgacatctacatgatcttcgtagctgtatacaaacaccgtcacatctttttttccttttctcgtcttaatgacaagcggatcggctccgttttgcggatgaagataacgctcttcatcccctgggtatatataatgccgttcgataaacacggcttcgttaaaatcatcaatcacccggcgtttgtcttcgccttccagacgttttccgccgagggaaacggcagcggacgcgtcactgagctttgaatgggtttcaaacttgcggaggatccattccaccgctccggtaggaaggcatgtcagcacaatcttaatcaggcttatgacaacaattgaaacaactgcaatccatgtcaccttacatcatctccatacttgttctacctgaatcttaacatagaagaaaacgttgttttttgtacattatgtgaaacttgatatatgttcaaaaaaaatccggatcacctaggtgatccggatttttcaagtttgcttctggtcgtcacggcggacggcttctctcagctcttccgcgacaaattcgacgttcggcccgataatgacctgcgccgttttattccccgttttgataaccccttttgctcccgcttttttaagcgccgcctcattaatgagagacgtatcctgcacggtcagcctgaggcgggtcgcacagtgatcaatcgtttcgaggttttgcctgccgccgagccccttgagcatggcatgttcttcgacggaaccggccgtatcttcactaagcacttcttcctcttcctcatcatcttcccgtcccggcgttttcaagtttaacgttttgatgagcatatagaagacgacaaaatagatcactgcataacaaagcccgacaacgagcagcaaaagcggtttttcggcaatgccgtagctgaggagataatcgatcgcccccgccgagaatgaaaaacccgacctgattccgagaacattcacgataaataaagagaacccggttaatatagcatgaaccccgtacaaaagcggtgataaaaacataaatgcaaattcaatcggctctgtaattccggtaataaatgccgtcagcgcgagaccaatcatcattccggccgtcgctttgcgcttacttggcttagccgcggcaatcattgccagacatgcggccggaagcccgaacatcataatcgggaagaatcccgtcatataagttcccgccgtcggatccttcgcaaagaagcgggccagatctcccgtttttccgtgaaaatcgccaaactggaaccaaaaaatattattcagcacatgatgaagaccgaatggaatcaaaagccggttaaaaatcccgtaaatcccggcgccgattccgccaagcccgatcatccattccccgaaagacgtaatcaccgactgaatcggcggccacacaaatccgaagatccccgccaaaataatggtaatcagcgccgttacaatcggaacgagcctgcgcccgctgaaaaacccgagatattcgggcagcttcgtatccttaaaacgattatacgtgtatcccgcaattaaccccgcgataatccctccgaaaacggccatattatttgtcgaattgattgattttacagccgcgtccagcatgatataagaaattgctcccgacagagcggcggccccgttgctgtctttggaaatcccgatcgcgattccgatcgcgaaaatcagcggcagatgatcaaatactgcggtccccgccgcgtaaatgaacggaatatttaataagtcctctctgccgatggccaaaataataccaacggcgggcagaacggcaatcggaagcataaatgattttccgagtttttgcaaaaattgaagcattttacccatcccccttcttttttcttaaatataccacataagttatctagtgatctataccaattttccttcatttattcacataaggcttgttggttttctatttataaaccagttgtggtaagcttgaatcagatgattaaaaatagaaagcgggaatgacaatgattgtaacgaacgatcaagaattagaaggccttaaaaaaatcggcagaatcgtcgcgctggcgcgtgaagaaatgaagaaaaaagccgaacccggtatgagcacgaaagatcttgacctgatcggaaaggctgtgcttgacgagcacggagccgcttccgctccggagaaggaatacgatttcccgggcgtgacatgcatcagcgtaaatgacgaagtcgctcacggcattccgagcgcctctaaaatcttaaaagccggagatcttgtaaatatcgatatttcggcggaattcggcggtttttattccgatacgggaatttcatttgtgctcggagaaggcgatgaacgtctgcaaaagctttgtaactgcgcagcatcggcatttcagaaaggattggatcaggcaaaagccggcaaacgccaaaaccagatcggcagagccgtctaccatgaagcccgctccaacggatttaccgttattaaaacgctgacgggccacggaatcggcagaaacctccatgaagcgccgaaccacatcatgaattactacgatccgtttgataacgcgctgtttaaaaacggaaccgtgatcgcgcttgagccgtttatttccacgaaagcggaaacgattgttgaagcgggagacggctggacgtttaaaacgccggataaaagccttgtcgcccaagtggaacacaccatcgtgatcacaaaagacaaaccgattattttaactgcactgtaatgtttcatctcccttccaaacaggtatacaacaactaacccgaaggagggagacgcatgaaaaaagataaagaaaaaatcaaaatcgaaaacgaaatacacgccatgcacggcgtaacgaaacagcagattttagaggatttcgaggaatttaaggcgtaccttcatcagaaaatttccgccggaaaaaaactgggtctggatgacagcaaaatcatcaaaagcgccgccatcctcggggactatctcgccaaacacgaggagccccgcaatgcggaagaaaaactcttacaagaactgtgggacattgcggatgacaatgaaaaacagcatttggcccagcttctcgtcaaacttgccggacactgatacagtgcccggcttttttatgctccgttataagagttgtgctacactggacatatgtctgtgaaaggagccatttttcaacatgtggtttattatcttcgggtttattttctttattgaaagcatcattctcaccgtttacggagtgaagaaaaagaaggggatgctgatttatttcggcgtcgttttcggaatcatgacactcggaacggtgctgttaaaattaaccggccattaagcatgaaaagaccgccctttacatatatatgtaagaaagctttacatctctgaatcgaaagtctcagtttttgcgttatcccttttcagcgtctttttatagatgttacaatgccaaaagtttggcaaaaactgaagaaacctccccagcgggagaacggagaaaggagttttctgacatgcattatggcagtaaaggctggtatgtagaagagttaaagaaaaaaggaattacccactatgaaggaagaaagcttcaaagcttcaaaaagtacttccttgccaatctgctggaaacaaaaaaacaagcataacgtaaatcagccgtgctgtcagtgcagcacggctttttttctatacattagtgagcctgtctctttttttaaggaaggactccctccagctttctgacagcgcttcttcccgcagtatttcttcaatcgctgacagattgccggaatcacgatatttcacttcattcgcataccagacggaaatgctttcttttcctctcgacagacgcttgaggacgggacgcggatcgacatatccttcttcaagcaccctgaaataaaagccggtaaatcccgtctgctgtacacggagcaccatatctttgatgccatatttgagcgcgagtttgacgcagggctggcgcggctggcttacttgaacgacggcttcccccagctgaaagacgtctccgatccacacgtcttgttcggcaagtcctttgaccgttacattctccccgaacgcggcggcgggaagttttctcgcgagcgttgtttcccaatatgaataatgctcggcgggatacacgcacaccgctttatcggggcctccgtgatgcttcaagtcggcttgcccgtccccgtcaaaatgggttttatacagcatgacgggagaatctgcgggccgctttatgatgccggaattgatttgtctgccggcaaattcatgaattgcgggctttccgagattgatagataagacagaatagtcttgcgtcacctcgttcacatcctttgcgaaatctcatatctttcctttatcatagtaagaaaaaggtggtttttccatgcttcaatatcatatgattgcagacggccgggttcagggcgtaggttttcgctacttcgtccagatggaagccgacagacataaggtagccggctgggtaaaaaaccgtgatgacggccgggtggaaatccttgccgaaggtcctgaagagtcgttaaaacaatttgccgaagcagtcagaaaaggcagccccttctcaaatgtcacaggcgtaaccatcgaagaatcacaccgtctgaaagggtaccgcacttttaccatcagttactgataaggcttgtcctgataataataattcggcttcacaatcgtattgtcatatgatttatggaaaatgtgggtggaagccggcgagatcggcggaatcagccaggtccagtcgcccgtcagctttctgcccgcgtcttgttcctgttcttcaaagcgtttaaattgattcgccgccgtatggtgatcgacaatgctgacaccgtgttttttgtatgaatagagcactgccttattcagttccaccagcacctgatctttccacaggtcggtattcaggctggcggaaatccccatgaccgcagcggcttttttgagcatatcataccgtttttcgtcagcaaggttccttgcgccgatttcggttcccatataccatccgttaaaaggcgccgcgttgtacgacagcccgccgatttcaagcctcatatcggcgataatcggaaccccgtaccatctgagatttaaatcggcaaactcttcaatatccggatgggtgatcggcacttctttcacgagcgtctgaggcaggtcataccagaccggctgcccgtcccctttcatccggaaaagcagcggcagaatatcaaaatcggtccgcttcccgcgccagccgagtttttcgcagacagccgtcagctcatatgatgccggatcaccgactcttcctttttcagtctcatatcccgcatagcggatgagctggtgattccagatctccacttgtttttccccattcttctcaggagggaaaatcgtaatcgtcggtttaatttttccgccgttcgtggcgatttcaatatgttcaaataatgcgtcgcgcacctcttctttcgttttcacaccgcgccggtcaatgacgttcagcgattgccagaacagacgcccgatacagcggttgctgttgcgccacgccattttcgccccgtgttcaagctcttccgccgtatggacgtaactccccgtccgatctatctcatcttttatcgcgtgtagtcgctcgttgatttgcgattccattccgagttcctgatagcagacatcaataaaatccttcgcctcatcccaaagtatttccgtatgtttcaaaaaactctctccttcaatttacatctgtttcccattgtatcgtttttaggtgtgaacacaatggtttttttgtatcatactggaaactgcaaagaaaaaacacctgtgatgttcgcaggtgttttacaaaacggaatgcagtttttcagccagtgtaagcaaatcctcacggtagttttttcccgtcatcggaattccgtgacccgtcaaaagcgcttccggctccagttcggccaatttctcaacggatgcggccgccgtctgcgtatccgctgtaaaataggcgggcggcccgtgaagctcttgcttttgaatgacaacgtccgcaagcgattcctgttccacagtgatcacggcatcaccggcaagcagaacgcggtctttatcccggaataatgaaatatggccgggtgtgtggccgggcgtatgcacccatctccattcttcaagaaacggaacggtaccgtctgaaggcagtgcctgaacggacggaatgcggatcgtatggcgcggaaacagcggtgacagctttgcgacaagcccttttttcgcatcgggcctggcaggcggataatccgctttccccgtgacgtacgggagctccttttcatgaatataaaccggcacatcccaaagctcaagcagctcttcaatcgcaccgacatgatcaaaatggccgtgtgtcaaaatgaccgccttcagctgatacccctctttgaatcggcgtttcatttcttctgttatcatctccgccgattgaggcattcccgcgtcaaccagaatgatttcccgcggagctgagggattttcgataaagtaaacattcgcaatctgcacggtcagtccgtaaacgccgtccgccgctttaaaaccggcgccgcttctcactgaaaaaagcggcataaacggatcactcatcatggcacctcctctgatgcctttagtgtgcgacgaaccgggtgttttatgttaaaaaatcgtgattgcgccgatgatgagcgcaaaggccgtcatgacgataacggcaagaaccgcccatttcatcgcaaatttctggtgttcatcaatggtgaccccggcaagcccgactaataaatgcgtcgacggcacgagcgggcttaacatatgaatcggctggccgataatcgaagcgcgggcgatttccaccttatctacaccgtacgccacggcggtctcggataaaatgggcagcacgccgtaaaaataggcgtcattaggcatcagaaacgtaaagataccgctcgttaaggcaacaatcgccggaataaaacctcccatctgttccggaataagcgatacgagggaaatggccatttcatcaaccatcttcgtccccgttaaaattccggtaaacacgcctgcggcaaaaatcatcgaaccgatcgcaagcacattgctcgaatgggctgaaatacgctccctttgatcgttaagcttcggatagttgacaatcagcgcgatacaaaacgcaatgatgaacagcacggttaaattcacttttcctgacactaaaaatcccactaaagaaagcgttaacagtaaattgaaccaccacagtttcggccgcctccattcatcttccgcagccgcagccgtttcatttgtatgggacggctgctttaattcgatcaccccgagccgttttctttccatccttccgagtacataagcgaccacaatcatacacaccattccgctggcaatgacaggcagcatcggccccgtcagctctgccgggtcaacgccgagcgcactcgccgcacgcggcgtcgcgccgccccatggtatcgtgttcatgatgcccatgccgacaccggcgattcccgctaaaataatcggacggattccgagcatgatatacaaaggcagcattgcgcttgtcgtaatcatatacgtcgtcgagccgtctccgtccagtgcgacaagcatggtcaaaacggctgttccgactacaattttgagcgggtcgcctttaaccagctttaaaatacgcgacaccatcggatcaaataaaccggtatcaatcataatgccgaaataaagaatcgcaaacataatcatgactgcaatcggtgccacctgttcaatcccggaaatcatcatctcgccgacccggttaaaagaaaacccggcaaacagcgcaaacacgatcggcgttaatacgagcgccgttaacactgaaagccgttttgtcataatcagcaccataaaaacaagcatcataagaaagcctaagattgctaacacagtatgtcccccttatcgtgaatacgcttacattttaaaggcccgatcccctttatccgcctttttgctatcttatgagaattggatattgaagtaaatattttggattttaaagatttttaattttttataaccttttcgttcattttgttcatttataaataaaaagcctcccgcaaatatgcggaaggcttatttttcgctgctcatcatctctttataaaactcggtctgctcttctaaaaagcgttttgcgccgctgctgtttttataaaagctctcccaatcccgttttttcaacatttgcttccactccgcggatgaggtaatctgtttcaaagcctgatcccaataggcgatctcgccttcggtcatgtctttcggccccatgatgcctctccagtgcgcaaagacaaacggcaccccctgctctttccatgtcggcacatcgctgaagccggagagccttttgtccgacgtaacggccgccaatgtgattttccctttccgataggcgtctctcgcttctgaaatggtcattgaggcggcgtctatctcgtggctgataagagcttcaatgacttcattgctgctcccgtattgaaaaaagcggatatcaaacggagaaatttcggccatttccgccgctctcgcaaaggagagctggtcatcatttccgaggccgggcgcaaatccgatttttatgccgcccggatgtgctttaatatcgccgagcagccgctttccgctttttatctttgaatccttcggaagagcgacggtctgccactcttttgcgattattgccaaaggcgtaaaatcagctgccttcagccggctttgtcccaaaatttcattgcttaacagcaggcttgaattcatactgatgacatccgtttttcgttcgtttacatatttccagccgctgtctccgcctccgccgggtttatagacgatctttacgggccggcctaatatttgcttccgctctattaccgattgcaaagcttttgccgttacgtcccagcccccttgaggcgccgccgggacgacaatttcaaccggcccttcagctgaacggatgcccgccacctgccgtccgtcaaaagaaaccagcgccgccagcatgacaagaagcactcccaaccgcttcatttctcccatcccttattcatgtgctaaataatatttccgttccggcctgccgataatgccgtactctaattcagcgagcgcttcttcccgagaaacgagaaactcggcgtagcgccgcgccgttgttctggaggcgcccattttttcgcccagttcttcagccgtcatccctttttgggccgccctgagcgcgtttttgattttttgaagcgtaatcgaattaatcccggtcggcagatcattgagctgtttttgttctttctgaccgcttccgaaaaacatgtcgataacggactggctcagctccggctgtgagtgcagccattctcttttttcacggtactgcaaaagcacttctgtaaatttatgtgccgacaccggctttatgacatagtgggaaacgcctgatctgagcgcttcctgcagcagtcttgtttcggcagaagctgtaataatgatgatatcaacggaaggaaaacggccgcggataaggggaagcagatctgttcccagctcatccggcatataaatatccaaaagcagcagatcaggctgccgtttctcaagcagcgatatggtgtctttggcattgattgctttgccgatgacattgaatccatcaagatgttcgataaatttttcatgaatttgcgctattcgaaagtcgtcctctgcaatcgcgatgttaatcactccgattccccctttggcctttctttcggtataaacaccgtaaatacggctccgccgctcttttgctgcgaaatctctatcgatccctgtaattcactgacggcttctttcagattggctaagccgtatcctctccttgtcccctttgaagagtagcccttttcaaatatggtttctgttttttcctgaggcacgccatcccctgagtccgccacttcgatgacgatatccctgccgatatcagtcataaaaaaggcgacctcttttttctctttttcggcgacggcttcgaaagcgttatcaataagatttccgatgatcgtaatgagctgggatgaacccacatgttccggcagcgattctaaaaagctgttttcatctattgaaagcttcactttcttctcagacgcctttcccatttttcctaatagtatggcctgaacccgctgtgaatgaatgttttgaaagaggatttcatgctgttcattctggatggcgtactcttcttttatcagttcaatggcttcattatattctcccagctctaacagaccgagtatcgcgtaaagcttattcgagaattcatgcgtttgcgcccggagatcctccgagtattttttcatttcagtcagcttgttaatcagtttcttgagctctgttttctcccggaagctgatcaccgctccgtatacttgtccggtctgcttcatttctttcacgtttaagataaatactttatctccggcacgcacctccacgttcggcggtaattctccccctgccaacaccggcatgagatttgcgcccggcatgatttcttttatatgccttccgatcatcggttccggaagattcagcatatcagccgcagataaattcatcatggttaccgcgccttctttgtttacggcgataatcccttctttcatcgcaaggagcatcgcattgcgctccctgtacagtgctgcaatttcatgcggttcaaggccgagtgtatctttacggatgctttttgcgagcgccgccgctcccccgatgccgataagaaacaccaaacatgcaaaatagcctaaatgccgcagatgcgctttcatatctttttctatctcatcttgtaaaaactcgactgtcaccgttccgacgacttcgttatgatttttttcctccaaaataaccggggcgctcccccggacagccttcattccgtcggaaaccggtgacccgccgaacatgacggttttattttgcaaattttgattttctttcggaatactgcttcgggccgaatgaaatgcaacatgccctttttgatcagtgatgtagacggcgtgcgcgcctgcctgttctttcatttgttcaatgacgtctaactttgtaaaagcctcttgatccgcaagccggaacgcctcttttacgggaggcatatatgaaatggtttttgccatttgcaccgccagctgttcagcctgcttctggccttcctttaattgctgaaaggcaaatataactgtgagcgttccgatgacaagtattaataaagccgcaattaatccggcgattttcatttgcagagagacataaaaccgcttcgcttccaacacagcaccagccgtcctttcctcctaaaatcataccattttttaaatctttatttctcatttttgagaattttcgtgatctttttctcttgtcatttcttttaaaaagtgcagtctggtataatttccctcaagagagataagaaggataactttttataatcgctgcgcaaaaaaagactgacagaagccagtctcgggatgtttcacaacggacgtatattcagttgacaaagtgtttctctatgatggccgagatacatttgaatgacctgaaatatcaatcaattttcctttgacggccaggcgtccttcggttcttaccgccttgtcgcatgtgattaatgtaatctctttatcttttgtctcctgaattgcgtttgcttctatttctgaaatcatggtttttgatgttacagaataaatatagtcttttctaaagtcggtcatcacgatttgcgcgcctttttttatgtgtaaaagagggccgaacaataggttctcctgcttcagatggtggcctgccaacgggtagtttccctcgcccattttctgatccggacgcatagttgccgcgccgatcagcaggttttcattggttgtgccttttaaaatcggaaggtctaaatcgatgctgctgatggttatccgtccgattatcggttttggtttgcgattaaaacttgactgaactgtttccctgaaaccgggcggatgaatggattcaaaatcatagtccgcttttttcatgttatttttccgcgcttgttctgcggttaattccgattcaatttggcttttactgaggtacgcgatcaaacagcctttcatgagaggtgaggaaatgagaagcagcccggacaaaataagaacggcaatgatcatttttttaatcatgaagaaaattcctttcttgtacgtcatgcggtgagtatttggtgagaaatgattctctttttaaaaaagcacctgatcgattcttacatgatcaggtgcgataacgtctatctattccttgctttcttctttcttgatacaacagccgcggctccgccggctaatagcagcagaataccggccgtgaccggcatcataccgtccgtatcaccggttttcggcaggtttttgcctgtatccgagtgattggttttaccattggtatcagggtgatgcccgccttgattcgtttgatgattcggtgtgtctttcccaggtgcgggattttttaatttcttattagaaacgacgacctcaacggcttttgactgtcctttttcaattgtgaattcaattggtttttcgttcagctgatagccgtcaggcgcttttgtttcgataaatcgatactgcccgggcgctaatcctttcaccgtaaaccggcccttttgatccgtcttccataccgccggccgttctttgctgccgccagtgtttaccggatgtccggcagaatccgtgatcttgaattcagcaccttccagcaccttatttttatcgtcatgatccacttttgtcagtgtgacatcaccaggcgtcagtgtattctccgcactgatttcgactggttttatgtcgatatttgtgatcttgaatgatattggcgtttgatccaaactgtaaagttcaggcgcttttgtttcgataaattgatattcgcccgctttcagtccccgtacaataatttgtccgtgctcatctgtcgtcagaccctctgtcagtactttgccgtttgcatctgtcagattaaactttgcaccttgcaggactttccgtttgtcaccttgatccaattttgtgagaacaacgctgttcttgatgttaactgcagtcagggcagcctgattcggttttccgctgttctcagccttaatcgtaaacggcacaggggttgttgacagcagataaccatccggcgcttttgtttcaacaaattgatagtttccgggcgccaaaccgccggcgtcaattttgccgccttcttttgtcatcagatcgtctcttacggtttttccatcactgtcaatgattttaaattctgcaccgtctaaaacgtttccgtcttgatccttcttgatcagctggacagagcctttatagttgactgccgttcctgcgtcagttgactccggctttccttccgctgtttctgagatggtaaactcttttttctccgtatttaacacataaccgtcgggtgctttcgtttcaatgaaagcgtaatgacccggtgcaagaccggacgtttctacttttccgtccttatctgaaaccagatcttctttaaccgtttttccatcactgtcgacgattttgaagactgcaccttcaagcttcttgccttccgcatcttccttcgtcagccggacagagcctttatagttgacggccgttcctgcgtcagttgactccggctttccttccgccgattctgagatggtaaactccactttctccgtatttaacacataaccgttgggcgctttcgtttcgatgaaggcgtaatgaccgggtgcaaggccggatgtttttacttttccgtccttatctgaaaccagatcttctttaaccgttttaccatcactgtcgatgattttgaaaactgcaccttcaaggtttcggccttccgcatcttccttcgtcagccggacagagcctttatagttgacggccgttcccgcgtcagttgactccggttttccttccgctgtttctgagatggtaaactccactttctccgtatttaacacataaccgtcgggcgctttcgtttcgatgaaggcgtagtgaccgggtgcaaggccggatgtttctatttttccgtccttatctgaaaccagatctttctgaaccgttttaccatcctggtcgacgattttgaaaactgcgccttcaagattcccgccgtctgcatctttcttcgttaaagcggcttttcctttataattcaccattgatcccaattcaacatcaggtacttgattcttttcgttctttgcgattgagaagtgaatagcttttgtgtttacgataaaccctgatggggctttcgtctccatcagccgatagtatccggcgggcaaaccgtttatctcaactttcccatttttatcgctttcaatattattttttatcagagtataggtaccgtcgcttgattttttctcaagcttaaatacagcaccggccaaaggattattgttttcgtcttttttgataagcgtcaccttatttttttgatttatgactttatagagtgctcctgctgcggaggatttaccgtcaatcgtaacggagaccccgtttacataggcgtcgctgatggtgtagccgtccggagcttttatttctttcagtacataggttccgtaacggatattcccaaacgcaagtttaccggcatcgtctgttgtgcccgtacgaagcagctgcttgccgtctttagaccataattgaaagtcggctcctgaaagagatgttccgtctgatcctgttttagatatcgtcaggcttcccttctctcctgatcctgagccgccgccgcttgaaatggcgacaaacactgagctgttgttctcttgggtctgctcctcaacatttgtccctgatatcgacactttgttgctgacctgaccgctgctgccggaaatattaatgagagaacgatattgtatgacatacgcacggtcgatttgtttatagctgcctgtaaaggtgaggacaaatgattgttcaccggtggcattgtcagtttttatatctaatttatagtccttatctttttcaagcttcacatcacccggaataagatttccgctgctgtctttcataacgccgctctcattatattttgcttgatatactttaaaagaatcttcatctattatttgattctcatccggggtgtctttgacttttacgtcatccagtgtcgattggctggcattgacattgatgttccaatcgatatagtttccgttctgtttgccgcctttagaaatcaggtttcctccgtttgcgatggaaactgaacccgtcagcgttcggtctgcatggtcattattaaagtactctgctttgtttgtgtattgactctgtttaatgacctggccttttaatgacgttttaaattcaatcaggtatggtaaagcgtcatctgttttgagacgtacgattaacgtatttttgttgccgtctgacggctcctctatttcatattttgaaggatccagcgcctccccttcagtgatggagccgtttttgctgatggtatacgttttaacagcaaccgacccatgcaaaaattgctgaccatctgtgatcgtatcttttatataaggattttttgaaggttcgccattgtaattaatgccgactttccatgtgatttcttttgaaacggcgttgtatgagccgtttttgaatccgttatgggacgtctgattgttcggtgtgaagccgctcgattccttatttgtgcgtttgccgccgtttttatccgtccatgtcgactccgccgtattcttaatgggttcgtttgaaaagtcagcgttgaattttgtcttatacgtgatcttaaactgactgtttgtttctgcataatccccgatcaatgctattgtaaagccttgatttccgggtttttttgttaatatatagtctgttccttctttcagcgttttgttatcagtcgtgtcttgcatgtgaaatgaatcgtcaatgagcgccaggcctccgctggtgaattgatcatccagcgtccagtctttcattgtgtaaccgtttttattaactgtgattgtccaatcaaccgtcttcttctcatagtctgcatttgaataatttttgatcagattctgctgaatggcggttcccggagtttcctttgattcccctgtatctgtcattgctgtattggtgtatttgacaggactgtcaataatgaccccatcgttgacttgagattgataaatgatcttatatgctcctgtgacagtttgcttgaattttatttcaaagccgttcccgttatcagtcagcgtataatcctcaccctcttttaatggggcgccctcttgttcactgccgttctggctgaatgtaatcggaaggactttcaatgaaccgggaacaagatgcagatcgtctgatccgaacgtatccttgatgccggctttggattgatcaatctttttctcaccgtagttgtacataacagcccagctgaacgtttgggattctcctttataacctgtcgaagatttttctatcatttttccgtaacccgctgttacggaagcttccgcagaaattggctccgcattgtctccgctgaatgccgccttgtttgtcagcgtgatgtttccgcctttacccggctttgcctcatctttaatttccgtgtcatatatgagccggtaggctgaatcgatcgtcccggcgaaggtgacattaccgttttcgccaacggtataacctgaagttatctcatttccctgactcaccgagccgtcaatattcacatcaagttcatacactttcacagagcggaaagtcaattcgtccggaaggctttcagtcaatttcgcatttttaacttcttcttcctttttattaagatcaaccgtccacgttacctttccgggattaatacctttatccaatgaccctgatttctcaatggttttattgacattcggtttaaaataaaccgttacgtccggcgtatcagagttaaccggaaacttaatcttttgtgtggttgatccttttatttctttctgattgaattgggtgtttacatacaatgaccccttgacgttagtatcttcttttacctcgccgttaaacgtcatgatgacatggccgctcgtattaatggaaaaagttccgtacgtactatcgccgtcggtcaatggctggttcgtaatgtcattatgcatgataaattctttaggcagatcaaattcatatcgatcaccgtcgtttattgttttccccagctcattcggaatcgcccattgaatggtgatatttgccggagagttcgtattcgcagggttgtttttgtcatatggttttcctttttcatccgtcaatttcacatcagttaaaatattttgcgtaatccggcttccgcctgattgaaggcttttagcggcagatttgcttgaaaccgccatttttgattgactgcgtttagcagaaggttttgatttcgttttctgttctgctttatcaccgccgtccgcagatgctgattttttctctgtcttttcctgaggttcagcaggtgttgaagaggtgtttttttctgtttcggaatccgttgttccgtctttcttcacaggtattaacacctgctgggtcttgccggcatccagttgaaaaagagcttttgccattttcgtctcatctgttatgtcgggagtaaacttcgccgacagtgtaatggagcctttggcatccccggcatctgcttcagcatcgttcactttcacttccagcgtgctgctgtctgcttcagctttatatataccgatcacccgatcagctgatgtcagctcaccttcggcatcgttatctaatgtaaaactttccggaatctttaaggtgatattccggtcacttgcatcttccttgttttttagcgaccattcgtatgtcagtgtcactttatctcccggtgctaaagcgggctcactcccttttgacccgtcaacagtctgctgtctgccgtctttgactgcaactgaatcaaagaacccgctctcgctttgttgtgatccggaagcggctgcgatcggagtaaagctgacaacttggctgaagatgaaaaacagcgtaaagcatgaaattaatgccgccctcagccttttgctttttttcgggctgaacgaaaagttcctcactcccaatgtcttattcctccccttttatatagacttacgttcgaacaagccggtaagcatgggattctccttatccgaaccaaactacattgtatgaaatcggcctatacaaattctgtacatgggattatttcagaaataacgcacaaaaaaagaccggcatcagccggtccggtcattcaatcgtcaattgattttatccttcaattgtttatagcgttcgtattcctttatcgcctcttctacctttcccagtttattaaataactgcagtttgtattgtataattttatcgtcaccgggctctattttctcaacctgcaggcaaacatccatcgcttgatgatcgttcttctcttggatgagaaaaccaatcagttcgtacgctttgctgagccacagatgggccagacgcgctttttccggctccgcccacagatagccattctccatgagataatggttctcatatgacatgacaatgtccaggtgccgggttagtgcagctgcgctgaccggaggagcctcttttaatgttttttcccattcaactgtatcaacctttactccggaaagccggagaatgtatcctatatcggtattttctattgattggctgaagggcagctgaccgattaatttccgtatttgatatattgtcgaatagagctgggtgcttgcttttgatacatcataagcaggccaaaacatctccatcagcatgtctttactgaccgtacgcccttgattaagaagtaaaaatgcatacagttcacgggctttggatgttctccacttgactgttatgtatgttttgacaccatttaccgattgataaaagtccaggttcccaaaacattgtataacataatccgtcccggtattctcgtctgccgacctgagttttttattcattcggattcgctcaacagttgtcagcagccgggcatggtcaaccggttttaaaagataatcgacagcatttaattcaaacgctttgatcgcgaattcattataagcggtgataaaaacaacttggatattttcattgacctcctgaatcgattcagcaagctcaataccgtttatcacgggcatttcaatgtcaagaaacaccgcatcagctgctgaaagctccgaatgctccagaacttccgccggatcttgaaacgttataatagattgaaatgcgtttgtccgctcaagcatacgattaaaatgaagcaatgccagttcctcatcatccacaattaacgctttcaaaccgcatcccacccgtcaatatagatatatctgaaaataatttcaattataccatgcctaatgccctatatagttggattctttttctttctcttgttgtatcataacgtttgtgattacaatatttatacattacataggataatagaatgcccctgaatgggataaaggagtaatgatgtgaaagaaaaatttatttcgatttcgattatttgcggctacgctgctttctttatgctttttatggtcctgaatcatttttcaggatcatccctccctcaagcggaacagggcgtgatcaatctggaaaagtgggattttcaaaaggatggaaatgtccagctgaacgggaaatggattctatatccaaatcagatgctgtcaccgcaggcgcttcattcagcaaaaggaaaaaaccccgtactcgttgatgtccccgtcaatgtgaagctgttcggcaaaacggccgatgtggattacgggacgtacaaactgacaatccgatcaaatgaagacaatcaggttttggggatcagcacatcttatatctacagttcaaaccgcctttatcttaatgggaaattaatcggacagagcggcaatcctacagaaaaagctgattttaaggcgcagaacaaaccgtacagcagctttttcaggcttcacaagggtgacaatgaacttgtcctgcatttttcgaatttcggaaaagttcccggctgggggatcgcaaaaccgataacgtttgggactcaggaacaaattatacgcgagaatcaaatttccttttttaatgattccattatgattacggcttttttcattaccggtttatattttctcggcttttttttgcaacggacaaaggataaacatttattgttcttttccgtgatgtgtctgcttttttctgccattattcttatgatagggaaagaaagaattatctttctcctctttccgtctatttcattttcattgctgaattccttgcgtatcatctcaaccgtgcttgtcagcatggcggtttttctttatctcttttatgcatacagagaaattgtttcaaaaacgacgatcacctttttaaccgctttatccgggattatcttgatcactgattttatgtccggaagtttcattgaccatctctcatacattttacattctgtgcttgccgttacgactctgttttatattacatatatttttacgattgccgccataagaaaaataaaaggaagcacgtaccttacactcgcatccgtctcgatgagcgcttttgtgattcttactaccatttcagcttacagcggcaaaacggctttttcttttaattcgctctattcattgccgacagtcatcgctttattggcggtggttcttctgatggcgcagcaattcgccggagctttccgggacaatgaagtcctctcacggaaattagtcaaaatcgaccaactgaaagatgaatttatcgccaaaacttcacacgaattcaagacgccgctgaacagcattattaatatatgccaaacccttgtagccggcagaaaaaagaagacgatagaggaagagaaagaaaatatgcagctgatcatccgtatgggctacagactttctgatctcgtaaatgatattcttgacttggaaaaaatgaagcagggtatgctgcagattcgtccggttcccgtcgatgtgcatgccgtcatatgcagtgaaatgaacttctaccggcttttatccaaacataaaaaacttgccattcttaatcatgtgccggacggcctccctttggtgcttgcagatgaaaaccgattccggcaaatcttaaccaatcttgttgaaaacgcaatcaagtacacatccgaggggaacattattctttctgctgaaagcctgaatgacaaaatgattcaaatcacggtggccgataccggcagcggcattcctgaggctgatcttgaaaccatttttgattcttttcagcaagcgggagggacggaagaagatggaacgggtttaggtttaagtattgtgaaacagctcgtcaagctccaaaacggggacatctgggcggagtcagcggcggcgcaaggatcagcctttcattttacgttacccgccgctcaaattgattctttaccggaagcaaagaccgaacttcctgaatcacatcccgggcagagaatgtcggatatttcgctggtcacgccttattactcagaaaaaatcgatgctccgacgattctgatcgtcgacgataacatcgagagtttgaaaattttaactgatatgctggaaggtgttccttataacgtaatcgcagtaaaaagcggaaaagaggcgcttcaagctgtctcttcctcgaagcttgacttggtcatattagacttgatgatgcccgacatgacgggttttgaagtctgcacaaacatccgcgaaagattcagcatggtcgatctgccggttcttatcgttacggcagccattatcagccatgacaaatacaaggcgtttcatgccggagcaaacgacatcttacaaaagccttatcattactctgaattcaccgcgcgtattaaaaatttaattttgatgaagcatacggctcaccaagccacaaatttagaaatggcatttcttcagtcgcagattaagcctcattttctttacaacgtattaaatacgatcatcgcgctcagccatttggatattgaaaaagcacgggaaaccactgctgcatttacaaactatttaaggatgagttttgattttcaaaacacttcggacatcagctcattcagaaacgaactttctatcattacgtcatatctttctatagaaaaaacacgcttcggcaaacggattgatatcctttttgatattgaacaggacattgacttcccccttccacctttaatgatacagccattggtggaaaacgccgttcatcacgggatcagtaagaaaagaggcggcggacggataaagctgacagcgaaaaaacaaggcgaaaacacgtattttatcaaagtggaggataatggaaccggcatcatgccggacatacagaaagatattttgtcttctgatgttaatcgcagtgtcggcctgaaaaatatcaatcggcggctgaagcatttttgcggaagcgaattgacgatcaccagcaccccggatgagggaaccgctgtttcgatgatgattcacactcccggcccaacggatgatttgatctcactaaaaacgtcttcattaagatactgattaacttcaaaaggcatgtaaatacttctgccggctgtcgggaaattcccgtcagcctttatttacccaaaaagacgcaaaaacaaaaaagcttgaagaaaaagtgatatcttctccaagcttagatgatccgcaccagtctggccgttttcacttaagaaatcgtaactcccgcgcttgcatatcccgccactgtattaataagcgaaaggcctgtcgcagtggcggagaataccattaacagccgggtttgaggagttaccgcaatgttcagccctgtcgtgattccgttgctgatgctgccgattgacaatatgccggtgaggggaggagctaaagtgacggatgctccggggatcggcgtgaacgtattgttcggcactgtggaactgtataattgtgcggttatcgtaacagtcgagccgacaagcgacaatgctgcggttgtactgaaataggcggcaattgatgtaatggttccgcttctcggagccgaaaaagcaaagttcagcagagttcctccagccccggtaagatcaattgcacctccccctccgacattgacgcccgtcacagaattgccgaagccgacaaggctcaccgttccgattaatccgccggcaatggtcgtcacggcagttggaagacctgaagcatagggaatgatcgcgcctgctccggttactcccgttaccccggttgctccagttgcgccggttactcccgttaccccggtggctcctgttgctccagtcgaacctgttacccctgtggctcccgttactcccgtggcgcccgttatcccggtggctccggttgctccagtcgaacctgttacccctgtggctcccgttactcccgtggcgcccgttactccggtggctccagtatctccggttactcccgttaccccggtggctccggttaccccggttactcctgttgctccggttaccccagttgctccggttactcctgttgccccggtcgctccggttactcctgttgcgccagtatctccggttactcccgtggctcccgttactcctgttgctccagttgcgccggttactcccgttacccccgttactcccgttaccccggtggctccggttgctcctgttgccccggtggcgccggtgagcccggttactcccgttatcccgattgctccggttactccggttgccccggtggctcccgttatcccagctgcgccggttactccggttgagcctgttactcccgttgctcccgttattccggtcgatccagtagctccggttaccccggttgctcctgttactcccgttaccccggttgctccggttattccggtggcgcctgttactccggttgagcctgttactccggttgttcccgttactccagttgcgccggttgctccggttgctcccgttatcccagtggctcccgtatccccggttacccccgttactcctgttgagcctgttactccggtggcgcctgttaccccggtggcgcctgttaccccggtggcgcccgttattccggtcgctcctgttactcccgttaccccggtggccccggtaatcccggttgctccagttactccagtatccccggttacaccggtagcacctgttactccggtgagcccggttgctcctgttaaccctgttgctcccgttacaccagtggctcctgttactccggttgagccggttactccggttgctcccgttaccccggtctctcccattattccagttgcgccggttactccggtcgctcccgttatcccagttgcgccggttactccggttgttcccgttaccccagttgcacctgttactccggtcgctccggttactccagtggcgccggttactccggttgctccagtatccccggtcgctcccgttaccccggtggctccggttattccagtcgcgccggttgctccggtcgagcctgttactcccgttgctcccgttactcccgtggcgccggttgctccagtcgcgccgggatctccagtgacgccggttaccccagtcgctccggtattcccagtcgagcccgttgctccagtgaatcccgttgctccagtaaaccccgttgctccagtgaaccccgttgctccagtcagccctgttgctccggtcagccccgttgctccggtcagccccgttgctccggtcagccccgttgctccggtcagccccgttgctccggtcagccccgttgctccggtcagccccgttgctccggtgaatcctcttacatgaaaatgatttggatgacagcatggacaccatctttcatgacagcaagaagttttgcaacagaattcttcacagcaatgggcccgattttgataactgcgcctttgatttcttcttttatgttgaaaatgacagcaacactcattactattccggcagtcgtaatcccaagagtcgtatctgttataccaagtatctccttttctcattacaccacctctatttgcataatatttccacaacaaaaaaaggtgtggcaaaatcccacttctattgggcaaatttttaaatgttctttaaggctgcatcatgcagcatttacagaaaaaaagacctaactttgcataagtcaggtctttcatctttaaaatatcagactgctattttcatgaggttgtcggaaaacttatgctgttaaaatcgatattgagagcagttgctgtcgttaaattattagcagttgtgaagataaccctgagctggtaagtgttcgttcctgcggtcggcgcagtatccactactgtatcagcaatcgaaaaactatccgtagctgcgatagtactagttcgcgacagagttcttgtatgaatttgcactgctcccctatataatctcacttcataaacaaagtttgaattggctgcagttgttaacgcgacactgagtgcataatcaagctttacattctgcaaagcattaaccgggactgccagcgtagcaacgggaacttctgtatttaacggcggataaacagtgagcggcccgttggttcttgtgaagagcaaggttggtgtactgcctgtggcgccggttgggcctgttactcccgtggcgccggttgggcctgttactcccgtggctcctgttgacccggttgctcctgttactccggttgggccagttgctccggttggccctgttgcgccggtcgatcctgtggcgccggtgagcccggttgctcctgttactcctgttactccagttgcaccagttgctcctgttactcccgttgctccagtcaagccggttatgcctgtcgatccggttgagcctgttggccctgttgcaccggttgggcctgtcgctccagttgaaccggtcgctccggtggctcctgttactcccgttgcaccagttgctcctgttactcccgttgctccagtcaagccggttgggcccgttattccagttactccggtcgctccggttgagcctgttggccctgttgcaccggttggtccggtcgctccagttgaaccggtcgctccggtagctccggtgagcccggttgctcccgttactcctgtggctcctgttgctccagttagtcctgttacaccagttattcccgttactccagttggaccagttgctccggttgaacctgttacccctgttgccccagtcactccagttgcacctgttgatcccgttactccggtggctccagtcacacccgttgaaccggttgggcctgtcgcgcctgttattccggttgtaccggttgggcctgtcgcgcctgttattccagttagcccggttacaccagttgcgcctgttgctccggttgagcccgttattccggtcgctccggttgaacctgttatacccgttgctccagtcactccagttgctccggtttctccagtcggtcctgttgatcccgttactcccgttgaaccggttgcaccggttgctcccgttgccccagttactccggttgagcccgtggttccggtttctcctgttgatcctgttgcgccggtttctccggtttctccggttgaacctgttgctcccgttgctcctgttggaccagttgctccggttgaacctgttacccctgttgcgccagtcgctccggttatccccgttgacccagtcactcccgttacaccggttgggccggttgggccggttgagcctgtcgatcccgttgctcctgttacaccagttgatcccgtgaccccagttgggccggtttctccggttgaaccagttgaccctgttggacctgttgctcctgttactccagttgatcccgttgagccagtcgcgccggtttctccagttgggccggtttctccggtcgaacctgttacacctgttgggccggttggaccggtctctcccgttgggccagtttctcccattgcaccggttactcctgttgctccagttacaccggttattcctgttgaccctgttacaccagtcgctccggttactcctgttgaccctgttacaccggttgagccagtcgctccggttataccagttgcccctgtcgctcctgttgaaccggttgcacctgtgactcctgttgggccggtttctcccgttgagccagtcggtccggttgaaccaattgctcctgtcactccagttgcacctgttatcccggttgagcctgtgaccccagttgctccggttgagccagttggtcctgttacaccagttattcccgttacaccagttggaccagttgctccggttgggccggtctctcccgttggaccgatttctccagttacacccgttgcccctgttgggccagttgatcccgttactccggttgcgccggtttctccagtagctccggtatccccggtcgagccagttactccggttgccccagtcactccagttgcacctgttgatcccgttactccggtttctcctgtcgatcctgttgctccagtcactcccgttggaccggtcgatccggttactcccgttaccccagtcgctcctgttgttcccgttgctccggttataccagttgggcctgttgcgccggtcgctccggttatccccgttgcccctgtcgctcctgttgaaccggttgaacctgttactcctgttgagcctgttgctccggttgatcccgttattccggtcgctcctgttgcaccgattgagcctgttgctcctgttatccccgtttctccagtcactccagttgctccggtttctcccgttgctccggttgagccggtttctcctgttaagccagttgggcctgttgctccggttgaaccagttacaccagttgggccggttactcccgtcgccccggtttctcctgttgctccagtcactccggttgagccagtagctccggtatcccctgtcgagccagttactccggttgaaccagtcactccagttgcacctgttgatcccgttactccggtttctcctgtcgatcctgttgctcctgttattccggttgagcctgttgatcccgttggaccggcctctcccgttgggcctgttgatccggttacacccgttaccccagtcgctcctgttatccccgtcgcaccggtttctcctgttacacccgttggacctgttcccccggttgcgcctgtttctccagttaatcccgtcgcaccagttgagccggttgcgcctgtcggtccggttgcacccgtttctccggttgggccggttgagcctgttgggccggtttctccagtagctccggtatccccggtcgagccagtttctccggttgcaccagtcactccggttgcaccggttgaacctgttgctccggttgagccagtcgctcctgttacaccggttgggccgattgatcctgttggacccgtgattccggttgggcctgttattcctgttgctccggtttctcctgttggccctgttgcgccggttgggccagtttctcccgttgcaccggttacacctgttgagcccgttacaccagttggacccgttactccggttgagccagtttctcccgttgagccagttgagccagtcgcgccggttgaacctgttactcctgtggatcccgttactcctgctgggccagtttctcccgttgccccagttactcccgttgctccggttactcctgttgctccagttgctcccgttgctccggtcgctccggttgagcctgttgatcctgttactccagtcaaaccggttgaacccgtggtcccggttgctcctgttgatcctgttgagcctgttggccctgttgcgccggttggtccggttggacccgttaggcctgttgtacctgttgacccggttgcgccagttgcacctgttattccggttgagcctgttgggccggtttctcccgttgaaccagttacaccagttgagccggtttctcctgttgcgcccgttgctccggttggaccagttgggcctgttgcaccagtcgaaccggttgttcctgttactcctgttggaccggtttctcccgttgccccagttactccggtcgctccggttactccggttgaacctgttactccagttgatcccgttactcccgtcgctccagttgctcctgttgaaccagttacaccagttgggccggtttctcctgtcgccccggttactccggttggacccgtgattccggttgggcctgttattcctgttgctccggtttctccggtcgccccagttactcccgttgctccagtcacacccgttgcaccggttgggcctgttactcctgttactccagttgatcccgttgcgccagtcgctccggttgaaccggttacaccagttgcgcctgttgagcccgttgcaccagtcgttccggttactccggttccacctgttgcgcctgttgagccggttattccagttataccagttgatcccgttggacctgtttccccagttacacctgttgggccggttgggccggtttctccagttatacctgtcgccccagtttcccctgttattccggttgtacctgtcactcccgttggtccagtctcccccgttggaccggtcgagcctgttattccggtcgctcctgttgttcccgttctcccggttacacccgtgaccccagtcgatcctgtcgatcccgttactcctgctgggccggttactcccgtcgcaccggtttctcctcttgctccagtcactccggttgagccagtagctccggtatccccggtcgatccagttactccggttaccccagtcactccagttgcacctgttgatcccgttactccggtttctcctgtcgatcctgttgctcctgttattccggttgagcctgttgatcccgttgggccggttgatccggttacacccgttaccccagtcgctccggttgttcccgttgctccggttataccagttgcgccggtcgctccggttgagcccgtggttccggttactcctgttggccctgttgcgccggttgggcctgtcgatcctgttgcacccgtttctccggttgggcctgtcgatcctgttgcacccgtttctccggttgggcctgttgagccggttgggccgatttctcccgttacaccggttgcgccggtttctcccgttgccccagtttctcctgttgggccagtttctcccattgccccggttactcctgttgctccagttgcaccggttgggccggttggaccagttacaccattcactccagttgcaccagtttctcctgttacacccgttggacctgttcccccggttgcgcctgtttctccagttaatcccgtcgcaccagttgagccggttgcgcctgtcggtccggttgttcccgttcccccggttacaccagttaccccagtcgatcctgttgctccagttactcctgttgggccagtttctcctgttgatcctgttgcgccggttgggcctgttattcctgttgctcctgttgggcctgttattcctgttgctcctgttgggccagttattcccgttgcgccggtcgccccggatgcacccgtcgctccagtttctcctgttgaaccagttacaccagtcgctcctgttggaccggtcaagccggttgggcctgttgcaccagtcaagccagttgttcctgttactccagtcactccggttgagcccgtagttccggttgctcccgttgcaccagttactccggtcgctcctcttactccagtcactccggttgagcccgtagttccggttgctcccgttgcaccagttactccggtcgctcctcttgctccagttactccggttgagccagtggttccggttgctcctcttgctcctgttacaccagtcgagccggtagctccagttactcccgtcgcccctgttactcctgtcggaccagtcactccggttgggccggttacacccgttgatcctgtcgacccgattgagccggttactcctgtgggacctgttactcccgtcgcccctgttactccggttgatccagtcattccagtcgacccagtcgctcctcttgctccagtcactccagttgagcccgtggttccggttgctcctcttgctcctgttacaccagtcgagccggtagctccagttactccggttgctccggtcgctcctcttgctccggtcactcctgtggggcccgtcactcctgtgggacctgtaattcccgttacgccaggttcacccccggtttgcgccaatgaaacatcgtctattaaaaccgttccggaagaaactttacttactacaatgacggcaaaggccgcgccagaaggcacagtacttgttttatagatttcagaccatgtgtgaaagagcacgttcggcaaatttccgggtgtaatattttcttgaatggaactgatttgttcacctgctgcgctgacatatatgatctggagagtgacttggggacttggctcatttccgagcgttgcgagtgatacgaatagagtcactgacttggctgaaatgggaacgatttgactgaggtaagcatatggctgagctccaataaattgcgcagaatatctccctgaatgtgcaaacaaactgttaatctgggtatttgccgaactccaccccgctaatgtgccggtttcaaagcttccgtttataatcggattattcattcaatctttttccctctccttcccgttgttgaccgtcttacttattaagacagcatattaatacgggctgtgttttgacaatctaaataaaaaaggtgatttcttttcatcaccttaatccgatccttgaatggggaatcccgtcgcaatgagggagcggtttgccgctgcgacttgtgttacgtaattcgaagaaaggacggataaatagagctgatacgcggctgtttcatccgccttcatttcgtcgatgtacgtaaaaggaattcctatgatttgcccgcctgaagaaaagaggttccgctcttgtctctgtgtttgtatcgatacgccatttctttgcagctcgagagctaagaccaatgagaaatgagacgcgagcggatctaattccacatttacttgtatgacggcatccgttttcaccaattgatctgtcggcgcggctatcactgtgcttaacacgtttatcggtgttccttctaacggaatcatcatctggtctgctgtattttgaaaagctacagccggaaccgctcccggcggcccctcaggccccgggggaccgggcggacccgcctccccttgcggaccgcgggagccggcgggtcctcttttgccttcgggacctcgcagcccgggtacgcacaaggcagatcgattttcatctgaagacggaaaccgtttttccgtccctgtttccggcctttcatgttcacatggtaattgttcataccggtgtttcatatgtctgctcatatatttgtaaggtttctgtttcaatatcatgtattgattacggccgctgctcatattatcaccccggccatattctattcgcactggagtcatcatgtgcaggcccttccccttccttacagaaataaaaaaaaggcagacctgagtctgcctttttttcttctaccataaccctaatactttccaccataatccgccgatcacaagccatgtcacaatatggacgattgacaggataaagccgatggaccaccatttgctttgcgatatataacccgctccgaaaaagaccggagctgctcctgagccgtaatgcgtcgtcgaaccgaaaaggttgctgaaaaacgccaggctgagcgccgccaacagcggcggagcgcctgccgccacgatgacggcgagaaatgccgcatacatggcgctgatatgcgcggttgcgctcgcaaagaagtaatgcgtgtaataatacacgacaatcagaatcataaatgccacaatccatgaaaaaccggaaacagaagatttcatcatattgctgaaccaagacaccatgccgagctcattcaggaaattcgccagcatcacaagcgccgcgaaccaagtcagcgtatcccatgcaccttgttcctttttgatgtcctcccatgttaatacctgtgacaaaagcaaaacggataatccgatcagggccgtcgtcgttgcgtcaatatttaagcttcctccgaaaatccacagcgcaagcaccaatagaaagacaatgaccatggagagttcggattttttaaacggacccatttctttcaatttttccgttgcgattttagccgcatccggtgtttctttaatttccggcggatacagcttataaatgacgagcggcgtaatgattaagctcgccaatcccggtacaatggctgcgattgcccagcttgtccatgtgatgtccacccctgcgacatcgtgggccagcttggcgatcagcgggttcgccgccattgccgtcaaaaacatcgcagacgtaatcaagtttccttgaaaaccggtttttaataagaaagcgccgattttccgctctgttccgtctgccggcgttgatccgaaagtttcggataatgatctgataataggaaaaataatgccgcccgcccgtgccgtgttgctcggaatggcaggtgataaaattaaatcactgaaaagcagtgaataagaaaggccgagtgttttcttcccgaaccgttgtacgaatacgtaagaaatcctggcgccgagcccggttttgataaatccccgggaaataaaaaaggcgatgacaatcagccagattgtcttgtttccaaatccgcttaacgtattttcaatagatagcgttcccgttaacgcggtgactgccaatgcaaaaattgcaattgcgcccattggcaagggcttggagataaagccgataattgttgcgacaaaaatagcgaacaaatgccatgctttaggttcaagtccggacggcgcgggaataaaccaaatgattaatcccacagcaacagtaataagcaaaggaatgatttttactgcctgctgtttttttgcgtctttttctgaagccattacaggtctcctcctattttgttgtcttccatcccctatcccattttactacttaactaagttaataaacgtttttgttaattaaaaaacacaaaggaatattttcctttgtgtttcttgtttcttattttaatatgcccgacccggctttagatataacatctgattttacatttgatgatgagccgatggaaccgtgcaatgacggtgtccagccgacggactgacttaatccgttggcggccgacgcgttaatggaggagccgtttaaaagagtgccgtcttcatgaagcgcttttccgccgctgaagacgctgatgactttatcagcagccagtcccggcacttcaaaaacattattctgggcatatatttttgacgcgcggcccgcgccccacgcatagctgaacgggtatgcagcgcttttcgagcctgcgtaaaaattattataaatatgaacctgcccgtaccggacccgcggcgcgcgctggacgatgttctggtaatagttatggtgaagggtcaccttcagttttccctcatccgacgtcttgctgtcgctgtttccgatgacggagcctttgtcatggtcatgatatttattataggacaatgtaatataattcgccccgttggctatatccgtctggccgtcatggtgctgatattttctcccgtaatagtagggaaaaccgctgtcgggattcgatccgtcattaaaggtgcaatgatcgatccagatgtgcgtcgcgccgttaatggtgatattgtcatattccgagttccagttgccgctgctgccgtccgtcgggtcccattgcggaaaatagtcgtaagcgtcttgaaattcaatgttgcggatgatgacattgtcgacaccgttcttaatattaaaattcccgcctgtcactttggcatttgaacccgagccgatgatcgtcgtatttgaaggaatgtcaaccacgacccgtgccttctggtttttttgcgatcgctgtctggcgtcttcctgggtgcctgacggcgctttttttccccatttgtccgggtcgtacgccttcagataggcgttcggatcatatgccggatctttataatcatcaaagccgagcgttttattgcggtcgtccgtattcatattgattgtgccttgtatgtaaataatcttcggtgtgctgttggcgcttccccctaatgcagaaacgagctgctgtctgtttgatacggtgtatacattcgatgaagaggctttcgcgccgccggttgtcccgccggaagcggctccccagccgtcatttgttcctaacgtctgccgtcccagatcagcggcatagacgtccgcagggatcatacataaacaaaccgccagcataaataacatttttttcatgaattgtgctcctcctgattctttgttccaatttattacagatgaattgtatcaaatcagttgagaaacagcaccgaaaatgtacagaatgtgccttttggttttattgcggaaaccgcaaaaaaatcccaaggggccgaaaaccccttgggatctgttcagcttacgcccatgattttactttttcgttatccgtgacaaacagaagaacttttccttcatctaagcgcttttcaaattgtgatgcttcctcttccgaaaagccgatttcgtgaattttgttgcggagctcgtcgccttttttattaaacatattgccgactgcgtgtttaatgcccgtttctttcgctccgatggtattgacatcagtgttatcggccaggcggtccgttctgtcgtcatcatgtgaaagcacatatacgtcttcttttgcgacacccaattgctgaagctcttttacgtcctgcatcagtttttgatcatttgtatattctcttactaccggtttcattgataagtcctcccttttgttttgtatattggatgtttacccgatcaatcaaggatcaaacaaaagaaagagagttcagtgggaaaacgggcagattgtcggtggatattttctggcgggacatgttacagtagaaaaagcaacttttatcagaaaaataaaaatcttcttgagccgattaagcagggaggtggttcctattcattacttttcaccggaacagcgatttaacgcttgggttgtcagtgatttagtgaagcaggtattccgccggcatacccgctgcccggatggaataaaagagcttacggcctttgctgaagatacttttcatattaatatcgatttcgttttctctatcattatcaatatcggtgatatcgaatccgttctgccggcagaaattgaaaataggctgggttcttatctgaccgcgcttcagcccgtgattaccgctgacatgcttcattcttcaaaaacgaatgcctatgaatatttggaacatgagaaaaacaccgatgtgtatcggttattctattaaatatgcatataaggaaagaagggccctggtccttctttttttatggccgctgacggtttgattttgtaattgggaaatggttcgtgttacatttggaacaaccacttatcttgaaggaggattcagtatgccgaatcatcagcagcaaattcaattggcaagacgccccaaaggcgttcccgcccatgacgatttccgctttgaaacgattgccgtgcccgaaccgaaagacggcgaagtgcttgtgaaaacgagttatgtgtccgttgatccgtacatgcgcggacggatgcaggatacaaaatcatatgtagagccgttcgctttagatgaagccataacaggcggagtgattgccgaggttctgacagacggcgataagctgaaaaaaggagatgttgtgatcggaaatctcgcgtggcaggaatattcagccgtcaatgagtccgccctccgcaagttggatacggatatcgcacccgcccaggcgtatctcggcattttagggatgaccggactgaccgcttacttcgggctgctcgatatcggccgtccgaaaaaaggcgaaaccgtcgtcgtttcaggcgcggcgggcgccgtcggctcaacagtcggacagattgccaaaatcaaaggcgcgcggattgtcggcatcgccggatctgatgaaaaaattgcgtatttgaaagaggagcttcaatttgatgaagccattaattacaaaacggcggatgatattcaaaaagcgctggaacaggcatgtcctgacggcgtcgatgtctattttgacaatgtcggcggaccgatttcagatgcggtgataaacctgctgaatgaattcgcccgcattccggtatgcggagcgatctcatcgtacaataccgaaagtgaagaagaagacatgggcccccgcgtccagccgaagctgatcaaaacaaaagcgctgatgcagggattcatcgtcagtgattatgctgatcgcttttccgaaggtgcgaaacaattggccgaatggcttaaggatggaaagcttcattatgaagaaacgattacggaaggattcagcaatattcctgacgcattcctcggtctgtttaaaggagaaaacaaaggcaaacagatcatcaaagtcagtgatctaagttaacatgatgatgaaaaaaggagggctttgtcccctccttttcttttttttttcggatcagccgcgaagaatcaaagtaagaaagccgtcttcatcaggctccgtatcttccaaagtgaatcctgctgcttgaaagcaggctaaactgatttgattgtctttttcgatgcttgccgcccattcccgcacgctggtaaacccagggtcagtcagcagtttttgcaagatctgttttccgtacccttgaagctggtacaaaggattgacgatcaatccgatatacgcccgctcctccacaaactctatagagaccatgcctcccggaagctgcccgttatatgccataaggacagtatcgtcttcatctttactcaatcgtgcataccacgcgtctaatggcagcatcgcatccattctccgtctgatgttatcgtttttaaaccagtgttcaagtattttcagctcacgtaccttcaatatttgaaatctgtctattgacaccatcttcccgcccccgcctgaaccttttctattattttacaacaaaaaaacgaagggcttcccgccctccgtttcttatttctcagataattttccgcctgaataaacggcctctttcagctcaattccgagtgatttggccatttttttcaatttggattcttccatcggcgtgacaaggctgagtacggttccttctttaccggcccgccccgtccggcctgatctgtgaatgtacccgtcttcattcgggatgtccgcgtgaatgacgtacggaagatcatcgatatcgagtccgcgcgccgcaatgtcagtcgccagaagcagcggaaattctccccgttcaaacgctgataatatctttgcccgctccatttttttcgcttctccgtgcaggatgccgagatccacatggtgataggcgagtttttccgcatagacgcttaaatttccgatatctctgacgaacacgagcgcctgcatgccgttcagccgtgacagcttttgcaatagcttcactttatcccgctgatcgcagacgagatattgatgcgtgacgcgcgctttttccgccgtattccgctccactttcaaaacggccggttcgtgtgcgatggtattcagcacctgttctgtttccggctgcagcgtagcggaaaagcttaaaagctgtcggtctttcagcgtcgttttaatgatttttttcatcgtttcgcggtgttcctgtgtcacgagctgatccgcttcatcaagaacgatcgtcttgacttcatgcattttcagctttttcgcctgaatcaattcgagcaccctgcccggtgtgcccgcaatgatatgcggtttatttttgagcttttccacctgctttttcacgtttgctccgccgatcaaagacaaagcgcgaagatcagagccttttatccactcctgaatcacttgaaaaatctgcatcacaagttcgcgggacggtgctaaaatgatcacttgcggatgtttctgttccgggttgatccgctccagaaccggaagcgtgtacgccaatgtttttcccgttcccgtcggggattcggcaatgacgtctttcccttccataatcacctgagcggctttttcctgaataacggtcggctcctgaaaacctgacgcctcccagttttcggcgataaatggttgtgtatgctgtaaaaatggccatgtttgggtcatgtcgttctcctcaattcttaaaatctactccatagtatctcaaatgcaagcgccaaacgcaattttctttttccttccaagccttttaacaaacggtctcctcctttataatcataaatgagaaagacacaagataaaaaatgcgtgtctgataacgatagaggtgtaatgatgagtattttatccgtaaaagatttaagccacggctttggtgaccgtgcgctttttaacaatgtatcgttccgtcttttaaaaggggagcacgtcggcttaatcggagcaaacggcgaaggtaaatcaacgtttatgaatattattaccggaaagcttgagcctgatgagggtaaagttgaatgggcgaaaaacgtgcgcgtcggctacctcgatcagcataccgtgcttgaaaaaggaaaaacgatccgcgacgtgctgaaagatgcgttccattacttatttgcgatggaagaggaaatgaatgagatttacaacaaaatgggcgaagcggaccctgatgagcttgagcagctgcttgaagatgtcggtgtcattcaagacgccctgacaaacaatgacttctacgtgattgacagcaaagttgaagaaatcgcccgcggcctcggcctgcaggatgtcggacttgaccgcgacgtcactgatttaagcggcggacagcggacgaaagtgctgctcgccaaactgcttttagaaaaaccggaaattcttctgttggacgaaccgaccaactaccttgatgagcagcatattgaatggctgaaacgctatttgcaggaatatgaaaatgcgttcatcttaatttctcacgacattccgtttttaaacagcgtgatcaatttgatttatcatgtggaaaatcaggagctgactcgttatgtcggcgactaccatcagtttatggaagtctacgaagtgaaaaagcagcagctcgaagccgcctataaaaaacagcagcaggaagtggctgagctaaaagatttcgtcgcccgcaacaaagcgcgggtcagcacgagaaatatggcgatgtcccgccagaaaaagcttgataagatggatatgatcgaactggcggccgaaaaaccgaagccggaattccatttcaagcctgcgagaacgtcaggcaagctcatttttgaaacgaaggacttagtcatcggctacgatactccgctgtcacgcccgctcaatctcagaatggagcgcggacagaaagtcgccctgtacggcgcaaacggcatcgggaagacgacgctgttaaagagcctgctcggtgaaatccagccgctggaaggcacggtggaacggggcgagcatcaatacacgggctatttcgagcaggaagtgaaagaaaccaataacaatacgtgcatcgaagaagtgtggagcgaatttccttcctttacccagtatgaaatccgcgccgccctcgccaaatgcggcctgacgaccaaacacattgaaagccgcgtctccgttctcagcggaggagaaaaagcgaaggtcagactgtgcaagctgatcaattcagaaacaaacctgctcgtgcttgacgaaccgacaaaccacctggatgtcgatgcgaaagaagagctgaaacgcgcgctgaaagaatacaaaggctccattctgctgatttcccacgaacccgagttctacatggatatcgcgacggaaacatggaattgtgaatcttggacgacgaaagtgctgtaaacacaaaaaggaactcccgcctgtgcggaagttcctttttttcttaatgtccggcttttattccggcgagatgtttgcgtcccatgagaaggacaagcatgccgacaaaaacgacgatcccgcctactgtatatggagtgcttgcggtgaagtgttctgacagcattcccgcaatccacggagcgagcgcaccgccgataaaacggactgagctgtaggctgaagacgcgattgaacgttcaaccggcgcagaacccatcacagcggttgtcatgatcgtattcaccataccgagaacagcaccggcgacaacgatacatgtaatgatcaacgtctgatggtcagtccagatccccatgacgatgagaatgaccgcaaaggcgataaagagaacgacgagcgaacccactgttcccagcgctttgtgcacgagcggcgccgtaaagactgacgtaattgccagcaataacccccagccgaagaagacatatccaaggccgtgttcatctaaatccagcacgaacggagaataagcaagcaaaataaaaaatccaaagttgtataagaatgcagatactgccattgtcaaaaggcctttatatttgagcgccttcatcgcatcaaacacaccgacgcgtttcgccggtttcggcagcttcggcagcatgagtgaaatcgcgcaaagcgctatgaacataaggacagatactccgaagaacggagcgcgccatgagatgctgccaagctctccgccggcaagcggcccgacggaaatccccaagccgagcgcagcctcatacagaataatggctttggcgctgccgccgactgataccccgacaatgacggcaagcgcggttgaaataaagagagcattcccaagcccccagccgccgcgatagccgacaagctgagcgattgaacttgagcttccgccgagggcggcaaacacgatgataaaaataagtccgagaagcagcgtccattttgcgccgatccggcttgaaatcgcgccggagaaaaacatcataaaaccggtaacgagcaaataacttgtaaataacagagatacttcactaggtgaagcatgtaattgtgcggcgatcgccggaagaatcggatcgacaagaccgattcccataaaggaaataacacaggcaaacgcaaccgcccaaacggctttcggctggctgaataagcctgttttctgttgtgatgatgtatccatttgaccagacctcctgtttcatccattaaaagaaacgctatatccatagcgtttacagcaaaatcattcgattgattgaatggcgcggtcagctttttctttcattccgttaaggcgcgttttaaaatgctgaaatgtgctgatcttctcatcaatcatctcaagctggtggttcaaagcgtgctgaatctcttccagcttttctttccgttccttcggatccagtgacaacaagtacccctctttgtttaattccagctgacggctcatctccataaactgctgaagctcctgaagggaaaaaccgagcacttcttttgtgctggtgactttttcgagctcctccatatcatcttcagagtaaagccggacgccgccttctgtccgtttaggagcaggaatcaaaccaatctcctcgtaaaaacgaatggttcgttttgtcaatccgcttcgcttggcaacttgatcaatcttcatccattccaaggtgaatccccctcttgtcgtatctgtttctattatacaccatttgaaccttaacgtaaacgttaactttttatgcctgataaacttggtttggacaaaacgtttgtctttaaagcgccgggagacatctgtgtaagataaaaaaagccggtatgacccgccatctttctcgggggccgtaccggcttttcttaattctcaagttcttcaatcatcagtgacaattcggtccagcgctccatcgccgcttcaagctcttcagccgtttttgcctgttcggccatcagttcttgaatctttccgaaatcacttcccgcttcagcgatttccgcttccagacgctgatgcttttcttcaaggccggcgattttgtcttcgatgccgtcccattcaatctgatccttatatgaaagctttttgcgctttttcttcggctcttcttccgcctttttctcttcggccggctgttttaccgccgtcttcttcgcttttgcgtgttccatgtattcactgtacgaaccttggaaacgggaaatgacgccttgtccttcaaatacgatcaggcggtcaatgacgcggtcaaggaaatagcggtcatgggatacggtgatgacgacgcccgggaactgttcgatataatcttcgagcacgcttaatgtttccgtgtccagatcattggtcggctcatctaaaaacagcacattcggttcctgcatcagtacattcagcaagtacagacggcgcttttccccgcccgacagctttctgatatatgtctgctgcatcggacgagggaacagaaaacgctcaagcatttgttccgcggtgatgacatcgccttccgccgttttgacgatttcagccgtctcttttatatattcaatgactttcatatcaccgttcatttcgctgtggtcctgggtgtagtagccgatccggaccgtctgcccgatggtgatattgccgctgtcaggctgaattctgccggcgaggctgtttaaaagtgtcgttttcccgattccgttcggcccgatgatgccgattcgttcccccgggatgacaagctcattaaactgactgatcagcgcttggccgttataggtaatggcgacgttatcggcttcgatcacctgttttccgagacggtgggagccgatcgcgaaatcgagtgatccggagactgccggccctttttgctctttgagcgcctccgctctgtccactctcgctttttgtttcgtcgagcgcgctttcgcccctcttctgagccacgccaattcgcggcgcaggaggttttgacgttttgtttctttctgctccgccagcgcttcccgttcggcccgtttttccaggaatacttcatagtttcctttatacgtataaaggctgcctctctcaagctcgtaaattctgttcgtcaccctgttcagaaaatatctgtcgtgcgtgacaagcataacggcgcccggatattgcgataagtagccttccagccattcaatcgtttcattgtccaagtggtttgtcggttcatccaaaatgagcaggtcagccggctggatgacgtttttcgcaatcgcgacgcgctttctctggccgccggacagctcgctgacatccttcatcagatcggtgacgccaagtttggttaaaaccgttttggctaacgtattcgcctcccacgcatcattcgcgtccattcgggcctgcgcatcaagcagctgtttctggcgctggtcattttccggttcttcattcagcgcctgaagcgctttttcgtattctctcatcgttctcatgacggctgatccgccggaataaatatgttcaagaacggtttgtccggccggaagatcagggtcctgatgcaaaaactcaatatgcacgtttcctgaggccgtaatctcgccttcctccgttgattcaaggccggcaatggttttcagaagcgtagacttccccgttccgttcgggccgattaaaccgattctttcattctcttcaatatgaaaggagatatggtcgaataatgtcttatctccgtatgttttataaaggttttccgcttttatgatgctcatggtccctatcaatcctcacgtaagttcatgtgttcattttaaatcaggcgctggaataaaactagtaaaaggacagacaaatttcttggaagagatcattttgtccgaagaatgtttccgcctctccttttatacactggaggtgaagaggtgatgacatgatcagcgtcagtttgtgcgttatcgtgaaaaatgaagaggaagtgcttgcgggctgtcttgattccgtcaaagacattgcggatgaaattgtgattgctgatacgggctcgaccgaccggacgaaagaaatcgcggcccgttatacggataagatttatgattttgaatggatcgatcactttgcggccgcccgtaactttgtgttttcgaaagcggaaatggattatattctgtggctggacgccgacgatatattgacggaaaaggaccgtgaaaagctgattgaactgaaggcgtcgctttcaaaagaggtggacgcggtatccatgtattatcacgtcggctttgatgatcggggagaggtcagcttcagataccgccgcaaccgactcgtcaagcgtgaaaaagggttccgctggatcggagccgtgcatgagtatcttgaagtatacggaaacatcatagaaaccgatattgccgtcacacaccggaaatccgagaaaaagcactcgcctccctcagaccgcaacttgaagatttatgagaaaatggcggaaaacagtgaaacgatgacaccgcgcgatttgttttacttcgcgaatgaattaaaggatcacggccagtatcagcgcgccatcacgtattatcaccattttctttccacaaaacagtgctggatcgaagacgagatcagaacgtgccaatatctatccgattgctacagggcggtcggccatgaagaggccgccatgacgtctctcttaaaatcatttctgatcgattgtccgcggccggagttctgctgcaggctcggcgactattttgcggagaaacggcaataccggcagagtgtgttttggtatgagctcgccctatccgccaaaagcagtgatgcaggctttacccagctcgaatattccacctggtatccccatctgcagctctgcgtctgccactggcagctcggcgacagagaaaaagcgaagattcataacgacaaagccgcctcctatcatccgtcacatccgagtgtcctgtataatcaaaacgtgctcggcacataacatcgaaaaaaagagctgccccgtatgaagggcagctccttattgattacgctgtcggaattcctccgcttacactgtaaatttgggatgtcacatagctcgattcttctgaggccaaaaagacataaatccctgctagctccgccggctgtccggcgcggtttaatggaacggcaggtgtttccttgccgaatttcggaatgttttcaccgggctgtcctcccgaaatctgcagaggcgtccagatcggccccggcgctaccgagttgactctgattcctttatttgccagctgttttcctaagccgacggtaaaaccgataatggcatgtttcgtcgcggcataatccaacagcatcgggcttggattatacccttctacggacgttgtcgtgataatagacgcgccttccggcagatacggaagcgcggctttgacgagccaatacagcgagaatacgttgacttcaaatgtttgatagatttgttctgtggcaagatcgctgatatcatccactgcctgctgattgccggcgacaagagcgagcgtgtcaagaccgccaagctcttgatacgctttttccgccaattctccgcaaatcgcttcatcgcttaaatctcccggcagcagaacggcttttcttccctctttttcaattaacgctttcacttcttcggcatccggctgttcctcaggcagatagttaatggccacatccgccccttcccgggcataagcaatcgcggcggcccggccgatacctgaatcgccgccggtgacgagggcttttcttcccttcagcttgccggctcctttatagctcgtttcaccgcagtccggcacaggcttcatctctttttgcaaaccgggcggttcttgatattgttttggaaattcatcatgatcatatttcgtcagcgggttgtgcagatttgcatcagacatacaagactctcctttatcatgggtgatgtattcgtatgtgtacccctttagcatgacggatcaaacgtgtaagtgcagtttccgattgataaaggaaaaacaaaaaaggagcccgtaagctccctttttttatgactctccgagtacgttttcagccattttcgctaaatgctgggcgcttcccgaaatttcctgcatcgtggcagaaatttgttcaaccgccgccgcttggccgtttgtgttctggttgatggattcaatagagtcctccagccctttcagcaggctgtggatttttttcgtaatctggtcaatttggccgacgttgtcttttgaatgagtggcaagcttgcggatctcatccgccaccacggaaaagcccttgccggattctcctgctctcgcggcttcaatggccgcattcaaaccgagcagattgctttgatccgagatgcccttgacagtgacggaaatgtcggcgatttctcccgcgctttcactgacttgtttcgcctgagcggaaattccggtcatctgtgctgagaaaccgctgatggattctgagatatccgcgatggccgaagcggtctgttccacgacggcggacaggctttcagcgacatcatgaagcttggctgatttttcaaggctcgtgccgagaccgacgccgccgatgacttttccgttttcatcgtgaagcggaatcgctctggcgatcagcggaaatccgaacagctctttcggcaccatgcttgtcttcttctgattcatgcggatcgcgtctgtaatgatgtcccctttttgcagcgggtctcccggctttacattaagagaaaacgttttagccggaatattcacgattaatttttctgtatcataaattccgatggtgatgtcatcttggatcaggctgtttaaaaaaggcgcaactttgacaaatgcgtcaagcaggctgtgcgtttgctgctccgtctgtatactcatttctttcactccttcttaatatgggaattgccgtttttcatgctgaaccgaaatccatttcagcgtggtgaattcttcaaggctccattcaccgttcagcctgccgagacctgattgcttctcgccgccgaacgcgacgttcggttcatcattaatggtcgtatcgttgacgtgaatcatgccggtttcgatccgcttagcaaactcaacgccgcgctcaacgtttgccgtatgcacggctccgcttaaaccgaacggtgtcgcgtttgcgatgcttaccgcttcatcctccgtttcaaatggcatgatgcagacggccggtccgaacagctcctccttcgcaatgctcatctcaggtttcacatcttttaaaatgacgggctcagcgaccgttccgctgaatcggccggacagcaccggaaccgctccctcttctatcgctttttcgacagaccgtctcaaaccttccgcctgtctctcattgattaaagggccgataaccgtatcagggtccatcggatcgccgactttcagcgatgacactttcgcttcgtaaagctctgtaaatttgtcatatacagatgtgtgaacgagcacgcggttcgccgacatacagatctggccttgatgcgtaaaccggctgaatacggccgcattgacggcgtattcaagatcagcatcctcaagcacgatcagcgcgctgtttccgccaagctccaacagcggttttttaaagtgtttgaccgcaagctgtccgatatagctgcccactccggttgagcctgtaaatgagattatccgcgggacgggatgctcaacaaagctgtcgccgatctccccgatatccgtcacgataacattcagcagcccgtccggtacgccggccgcttcaaaaattttcgcgataagcgttccgccgcagatcggtgtttcttcatgaggcttcagcacgacgccgttccccgcgccgagtgccggcgcaacagatttcatcgaaaggaaaaacgggaaattaaacgggctgatcacccccacgactccggcgggtattctgtacagcctgttttcttttccgtcaatcgtggacgggagaattttcccttccatccgcaccggaaatgttgcggcttcttttatcatatttttgacaagtccgatttcaaactcagccttcagccgtgttccgccaagctcctccatgattaagtaaataatcgcttcttcgtgctcttcaatgaaagaaacggctttttccaaaatggcccgctttttaaaagggtttactttgtcccattcttgtttcgcaagagccgcggcgcgatatgccgcatccacgtcatcagacgtcgctttttggaatgaggtgatgactttttgagtataaggatttctgttttccaatacgttccggctgctcccatccctccatcggccgccgataaactgcttatttagttcttcatattgaaacatgtaaaacatctccctttcaccgaaacttgaaattagttgatgagtcatcttttgtatcggtcttaaggtgagaaaattgaactatttcacaataaaattcccgttccttccgtgcatcgacgctttttagctttgtccttttaaagtggaaaattctttaattgactgcgagaaatttcgacaatataatacaaacgtcagtgtatataatgataagaatattatgaattttcaggaggacccatatgtctttactatttcggaaaaagccgctggccgacttaaaggcccagagcaaacagaccagcctgtcccgctcgttaagcgcttttgacttggttttgctcggaatcggctgtgttgtcggcacggggatttttgtgattaccgggactgtggccgcgacaggcgcaggaccggctttgattctgtcgtttgtgctcgcgggccttgcctgcgcgctcgccgcgttttgttatgcggaattttcttcatccattccgatttcaggcagcgtatatacgtattcatatgtcactctcggggagtgtctcgcgtttttaatcggatgggacttaatgcttgaatatgtcatcgcgctcgccgccgtcgcaaccggctggtcatcctatttccagtcgcttcttgcgggcttcgggctgcatcttccggaggcgctgaccgccgcacccggcagcaaaacgggtgccgtgttcaacctgccggccgttatcattattttggtcattaccgcgattgtttcaagaggcgtgaaagaaagcacccgctttaacaatgtcattgtattgatgaaaattgcgatcattctgctgtttatcatcgtcggtttcggctacgtgaaaccggaaaactggtcgccgtttatgccgttcggaatgaaaggcgtcatcacgagcgccgcgaccgttttcttcgcgtatctcggatttgatgccgtgtcaaacgcgtcggaagaagtgaaaaacccgcagaaatcaatgccgttcggaatcatcggcgcgcttgccatctgcaccgtcctttacattacggtatcgctcgtcctgacgggaatgctttcgtacaccaagctgaatgtcggggatccggtatctttcgcgctccaatttgtcggccagaacaagatagcaggcattatttccgtcggcgcgattatcgggattacaacggtcatgctcgctctgctttacgctcaggtgcgcctgacatttgcgatgagcagagacggccttttgccccgcatgttttccaaggttcacccgcgttttaaaacaccgtttcaaaacacatgggtgacggggatcgttgccgccgggatcgcgggttttattgatctgggaaccctggctcatctcgtcaacatgggaaccttggcggcctttacggtcattgcgatcgccgtcatcgttttaagaaagaaacatccggagatcaaatcttccttccgtgttcctttcgtgccttttgtgccgatcatcagcgcatgcttatgcctgtatctcgcaagcagcctgccgggcgtgacatggctcgcctttgtcatctggatcgccgccgggatcgtcgtttatatgatgtattcgagaaaacacagtttgttaaataaataaaaagggaggctcttttttctgtttgagaaagaagagccttttttgcacttgataattcattcaccttatgaataatatggtgtatgcttcgtttacataaaaaggaggagaatcactttggcaattgccgccccgcttaaagaaaaacctgtccatcgtcccgaaacaaccatgtattctattttgttcattatcgggatctgtcatctgctgaacgattcactgcaagcggtgattccggcgatgtttccgatattggaacgttccatgaatcttacatttacgcagctcggaattatcgcctttacgctgaatatggtgtcttccgtgatgcagcccgtcatcggctggtatacggataaacgcccgatgccgtatgccttgccgctcggactcaccgcaagcatgctcggcattttaggtctcgcgttcgccccgtcttttctgacgattttatgctgtgtcttttttatcggccttggctccgccgtctttcatcctgaaggatcgcgtgtcgcctacatggccgccggcgaaaagcgcggcttggcgcaatcgatttaccaagtcggagggaataccggccaggcgatggcgcccttgattaccgcgctgattctcgttccgctcggtcaattcggctctgtctggtttacacttgtcgccgcaatcgctgtgctgtttctcatctatatcgccaaatggtataaaggccgccttattcatttgcgcgccgtaagtaaaaaatcaccggcctccgctgtgcagaccgtgattacaaaaccgattattctcgcccttatcatgattatcttcttaattttcgcgcgctcctggtatgtgagcgcgatcggcaacttttatacgttctatgcgatgaatgcctatcatgtcagcattcagcaggcacagagctacatcttcgtctttttatttttcggagctgtcggaacgtttctcggcgggccgcttgcagaccgtttcggaaagcggaacgtcatcttcgtttcgatgatagcatcggctcccttgacgattttccttccgtttgcggggcctgtcatcgcctatggcgtactggcgctgatcggtgttgttctgatgtccagcttctccgtgactgttgtctacgcgcaggagcttgttccaggcaaaatcggaacgatgtcagggcttacggtcgggctcgccttcggaatgggcgcgatcggagccgttgcgctcggagctcttattgattcagcgggattgacgccgaccatgacagccgtcgcctttctgcccgttttaggtctgctcgcctttgtcctgccgagcgacaaaacattaaaagaatggcattcataaaaacaatccctgccgaaaaggcagggattttatgtttcaaccgtataaaaatgagtgtcaggaaccgcatacttcggaataaacccgtctctgaaatcaggaaacgctttttgaatttcatcaatccatttttttacgtttttgatgtacggcacgtaaatcatattgactgtcgcctcgtcatcaatgtgatagtaccagcacagattgaattcgttctccgtgacgagcgtaaagcctgaaaaatgataaaaaatcagcggggtgtcattgacatatacagccccgccgcgcaggctgacgtcatattgctcaatattccacagcgccgcattcgcgccgatcgactccgtgacatgaacgtcttcaaactgcgcgggccacttttcaacatacctttggtcaccgtatgtctttttttcttcattcatctccaccgtacaataggagatgcaatcctgtctccactgccagaccgcccgatacgcttccccggtattccgcgcgccgacaaacccggtgttgtactgccccgtcagcttgtaataagacgcaaaccgttctgaattgcggtgatccgtcagaaaaagggaagcatccggcttttccgcaaacaactcgcccgcatctgagaagaaaaagagatcggtgtccaagtgggcaaaatattcggctccatcatactccgtcatcacatggaacagaaatgccggtttcagcgtccagcaatattcatgaaacgtccgtccgccctttgcttcaagcagctccgggtcctccatttcatggagctgaaccgccgtgacatgttcccacggcacctgctgaagcagttcgtacgctttctggtcgacacacagcacatacagatgaaaatcccggcaatgctcatggagagaatgaatcatcggcatcagtttaaagatatgcgttctggaaacaatggttgaaaaatgatatttactcaccatatcacatccaatttatttaagatccacatgcagtaaatcagcagccagcgctttgaacgcccttgcaaagtgcgtgacgcccagctttttttccgcttttgccaaaagctttccgacctccggcagattgaagctgttcgccgtgatccgcgggcttttcgtcttccagtccgggtcgaggttgcggtctttaaccgcgtgcagcagctcgagaaaaatgtgcagcaggctttcatatttctcataatcaagcagcacttcgatgtctgccatcatgctgttggttaactccgcgtcaaacgggccgttaaacgcgaggtgcacgtcaagcgaacgaatgtcattgtacttgtcgcacatgtacgcgatattcgccctgatatcatcaacggaagcgcagttgctcggatgctcctgatggacgctcatgatatcgcgccgcagctgaaatctcattcccgactgatgaagcctgatgccgagatcataatcttcaaagccgtatctgacaatgccttcatcaaacagcccgagatctgccacgtgctgtctcttgactgacgaattgttcgtaatgaaaaaacgccacggcagacggtagcctttcaaatcatctccgtatttttccaaaatgcttttcagcacacggataaagtcggtatctaaatcaaagcattggtcaagaaaacttccgtctctgatgtcactttcatcaaggagcggctctttatcgcccggcagctcttcatacagttcggcgagtttctctttatgctctttttcaaaacggtcataataaaagctgtaaatccgcttccagaacataccgcatacgactaaatcgtcccggttctcatgagccttgatatgcttcgccaccaaatccttttcggcaagcatgtcgctgtcatggaagatcaaaatatcgcctctggcattgcggaccgcctgattccgtccgtaagcgatccctctgttttctttaattctcacaaaaatcagcggaaaattcgcgctgaatgattcaagcatggataaggttccgtcttccgaaccgttgtcagccacaatcacttcgaacggctctgtgcattcctgttcattcagggacagcaggctgttataaagccgctccttggaattatatgcgggaacaatgacgcttgccttcacttttcgttcacttcctgtatatgatcatttatttgttatcatcctcagatgcaaagccgctgaactccgggcagacggcgctgaccgtcccgatcacccgcttcagaatgtcctgataaagctgatggacaaacggcaggtcggtccggtccgtctcatgaatctgccgaatgtcgccggctgtaacgatccggtatccgctgaaatgatagaaaatcagaggacttccgtcttcgagcacaagacgcccgtccttccatgaaaacgtgtggcggccgtaattccaatggccgatattcacgccgggcgtggtgatgtcacacacattcgggaacaggccggacatgtaatccaagtagccttgatctccgaattttccttcgcccggcgcatttttgcattcttccaggcagcgttctttccaccatctgagacaatctgtgccggcactgtcggttttgaagctgagaaaaccggaattataccggcctaaaagacgctgcagcatgtcgatttcctgttttccaaatgagggaatgacgatatcgccccgtgacagaagcaccgaacaatccggctgattgtcaaaaatcgcgcgcggatcagcgaagaaaaacaaatcggcatcaatgtacgtgacacgctctaattccggatgtccgtccagcacgaattcgagaaataccggcttcaccgtccagcagtattcgctctgatccctcgtccgcttcagttcaaggagctcctcattttccagtgcggacacctgaatcaaggtgacattatcctgccgcattgcctgaagcacgtcataggtgtcttggtccatacacaaagtaaaaatgggggcgtccgcctgaaccgctttcaatgagccgaacaaagcgatagcctgatacagccttccttttgataaaactgtgcaatatgcgcttgtcacgtctttctctcacctctgtttctgttacttttgaaaaaaggctttataccatttgatcgttttttccaatccttcatcaatggtatgtgcgggtgtccaattcagaagcttcctcgccttttccgccgataaatattggtgcttgatttcatggcttccctggttgagcactttcggcttgaggtcactgtccatggccttaagaattttttctacaagctccagcaccgtcagctgaatctcattgctgaagttgaacgcttctcccgcaagattgagctcctccatcttttccgccagcaaaaggtatgcctcgaccgcatcctcgatgtaaaaataatcacggataaatgtgccgtcgctgcggatttccggcgcttcaccgttcagcacgagctgaatcgtctgcggaataatccggttgaagttcaaatctccgccgccgtacaagttgccgcagcgcgtaatacagaccggaagtccgtacgtattaaaatatgtgtggcttaacaaatcggcacagctttttgatacgtcatacggatgtttgccttgaagaggcatgttttcatcgtacggcagtgtcggctggtcgccgtacgctttatcactggacgcgacgatcacccgcttgatgagcggatgcctgcggcacgcttcaaggatgttccatgtgccaagaatattggcttcaaatgtggaaatcggattgcggtttgcgacgccgacgatcgcctgagcggctaaatgaaagaccgtgtcaatttcatattcgcccagcgcccgctcaatcacatccagatcttcaagcgcgccctgcacgatattcatttgcttcacttgttctccctgatacaggttcgacttgggtacagtgtcacggacaagtcccgtcacattggccccctgatcgatcagttccttcaccaagcagcttcctaaaagacctgtacatcccgtcacaaacacatttttatttttccagaaactcaaacttgatcaccataccttccatacatgttgtccccggtcccacatcttgttgatttccagcaggtttttatacgtatcgatcgccgtccagaaaccgtaatgccggtataccgccaattcgccgtctttcgccagctctttcagcggttcttcttcaaacatgacatccctgtctttcggcagatactcaaataccttcgggctgagtacgaaaaatccgccgttgatgatgccgtcactcgaggttttttcagaaaagcttttcgccatgccgtcttcaaccgtcaacgttccgaattgcgaggacttttctataccggtgacggtcaccgctgccccttttgattgatgatagctgatcagatgaaacaggttgatgttggccagtccgtccccgtacgtcataagaaaggtttcatcaccgatgatgtcctttgcctgtaaaagccgccccgctgtctgcgtgtgttcccccgtgtctaaaaaagtgattttccacggctcggattttcccaatatccgtacttctccggtagagctgtccagcgtcatgctgtgattcttccagtcataatctaagaaatattccttaatcatctctcctttgaaaccaagaagcaggataaattcgttcacgccatagtattgatagagtttcataatatgccatagaatcggtttgccgcctatcatggcgagcggtttgggacgttcattggtgatttcgctcattctcgttccttttccgccgcagagaatgactgctttcatctctacccctcttctctgtgaatattggattcgaaaccgcccgtataagagaaacaacccgataatttgtccgattctctatcaccggtttcaaaatctactgtaagatatgagagattggcgccctttgtgaccaaaagctctctcttttttcagattggtgaagatacacacaaaaaaagagcctcacggaaattccgtaaggctctttctattatttattatcctgattcagcttttctttgccgtaatgatatttagacggatcaaccggcgtaaagtcgctcaatttgtggaatctgagcaagtctttgtacatcacgctgtcagacagcttcagctgctctgtgactctggctttcaggtttttcgtttcctgattgcctttcagttcttttcctgtcttcgtatcgtatacgacattggagatggaagtatatttcggcgtgacgtaatctccgttacggaacgtcaccgtatcatcatggtctttcgagaagagatcggtgccgaaattaatatatttcttagaatcgatgccttccaagtgaaggatcgtcggcacaacgtccatttcaccgccgtacgtatggttcaccccgccttttttgccggggatgcgaagcataagcggcacacgctgattctgcgcgttttgataaggcgtaatttctttgccgagaatttctttcatcgcgcggttatggttttcagagattccgtagtggtctccgtaaagcataatcaccgagttgtcatataaaccggatgacttcagatctttaaagaactgttcaagcgcctcgtcgagataacgcgccgtctggaaatagtcatccacagtcgcgtcgcccgttttcgctttttcgatcgttgcgtctttttcatcaagcgtaaacggataatggttcgtcagcgtcagcaaatgcgcgtagaacggctgtttcagcgattgaagcttcggaatggattctttgaagaatggtttatccttcagtcccatattgacaaggttgtcatcagacatatcgtatgtgctggcgtcaaagaatttatcgtagccgatatgtttgtaaatctggtcacggttccagaatgatttgtagtcaccgtgtaaaacggcgcttgtatagccctcactttggtcaaggatggcaggaagcgattgatacgtgttttccccttttgtcacgaaggctgacccttcaggcagtccgaacagactgttatccatcatcagctcggcgtcagatgttttaccttggcccgtttggtggaaaaagttatcaaagtacgtcatgtcctctccgccgcgggcgagtttattcaggaacggcgtgacttcttttccgtcaagtttgtagttgatcaaaaacgattggaaactttccaagtgaatcttaataatgtttttgcctttggccttgccgaaatactcggcgttcggcttcgcataatgcgacgatgtgtagttttcaacgctcgtcaggtcatcgctgctggcatatgcccgctgggattccgtctgcgccgtctgtacgccgtcataaatcgtgtaattataaaggcctaagtattttacaatgtaattgcggtcaaacgttcttgtcagcagctccgggcggtcctcttcggcaatcgccaggttcacgaagaacaaaacaatacccgtcacgataattaatgacgtataccgttttttcagcttgaattccttcagctcacgtctccacaccagaagtgcgattaaaataataatatcaacaaagtataaaatatcatggccggacataatgctgaagatgccgtctcccatatttcccacattaccggattgctttaagttcgggaatgtcaagaaatcatcgaagaatcgatagaataggatatttgcatacaaaataaacgtcatgatgaaatcaataatcaccatgataatcgctgatttgcggcctttcgcaaacaatgccagtcctaaaaagaaaatggcgcttgagaacggattgatcacaagcagaaactgctgcgtcggacccttcaccccaaggttgaattcagcatgataggctaaatacgttttggcccaaaacaaaataatagccagtacaaaaaaactaagtctgtaagaaaataatttcttcatggcaacctctactttcctaaacactttaaatctgtattcttactttttgcttcaattcctgctttccgagcaaaacgaaagcatcacacagccccataaacacaccatttaaaaaaacgatatatttatcattcgtgtcatgcccattgaacatcttatcccgccagccattagacgcaggatatccgttcttcgtttcacatttttttctggcattaaaaggtaccgtatcagacccggtctgaaaataggagataccaaatataagaataacacaaacttctaaaaacgaaaaatgaatatcaaagacagccgcccaacaggcgggctgaagttattgtatgcaaaggggctgaaaaacttgaaggttttttttgctgatgtaaaaaaaggactggagtcatccagtcctttacctgtcaaattatcgcttagaccctaaagatatacaaaaatgctttcttcacgtttaccttttgttttttataatccaaccatgcagcagagctggcatttgtgactgcttaaactgttctccaacactggtccttaacgcgtcttgcaaatttctgtttctcattagcgaaaaaaattgtgaactggtttcatcaaacccgccaataaaggaattacccacctgaaatgacaccccatgttgttctttggtcacaacatgcagcagctgtttaaattcttccagtgttaaagaagcacggtattgatcttttaaataggcttcttcctcacgagattgcgctgtgttaaggccctctcccaaactgttcctgtccaagtctacaatatagatacatgattgatctgataatagatggatgagtgtatttacaatagcaataggattcttaaagagtccaaaacatagatgtatgaatataatgtcttgcttcttagacacatattgcataatattttctgcatttgaacatataaaagatgcattaataccgagtttttttgctgaagaaattgcttgggcagaggaatcaatacctgtcagttcgatcttttgaaaccgactgttcaaatattgaattacttgcccctgtccgcaaccaatatctaatacagaatacggctctctattaaatttactggagtaaaacgacagaaatgtttcaattgaaatacttctaatggatgaggtttccctctcatcataccgaaagctcactttacttttctcaggatgagaaaaccatgtttgtgcttgaattctgttggcttctgactctctgacaattgtttcaatttccatataactgtgacacctccaaagagtttaccactctgcttgagacattgtcggcgaagatgtatttattttccttttgctgacaggacgaaaatactggatagttaaattatgcacaatatggaatgcagctactgataaaaaatcaaattgtgcagctattacagctattacagtaaatacagtcatatagggggctgactttacaccaccaaggggaatatggagcagtaagaatcctatcgagctaatacacgtacacaataagacagaatcaaagaagtatagtttaaatagaaaaggaatacaaattctccatattaattcctctgaaactgcgcataaaggcaggaaaatcaatgtatcaagtttatttacttttcttttaacaaatacaacagatttgtttttacgcttccagataacataaggaaaaaagaaacctagggcactaaataataaaacaccgtacgcattattgctatgtattaaaaaaaagttatcatctaataagaagatgctgcaacacataattccaccaaaaacggtgataatatcataactgcgctgcggtgttatatgacgagtcagtttatattccttagttctatgcttgatttgatacataactgttagctttgaaacatagggacccatcaaatgaatcaggatccctataaagatgcatacccttaactccatcatgttcctgcaactaaagtatatataggtgcatcgtctactccattatggccaccaataagatccatgagctcatcatctataaaccctccgtatggacggctctggatacattgggctgtggccaataaaatcatattctgcatcagatgacccgcttcaataaatataaatcgatatgaacgatggccatatttaaaccttgacctccaaaagctagccgatatgattacagcgaaagaaaagtcctttacagcttcttcttgtaacattattcttccgaaatcctcttcagagtactcacctagatgaactaggccctttcgataaggatcaaagtgatatagacctttttccaaagaatccaccttgttgctaacaacgtacagatccaacggataaagagctccgccagaaggaatagggcgtctaggaccttcagggcgctctattaatccataactaccctgcagaatggtagaaagctgtgataatgttgtactaccaccgttaaactgttcgatacttctcctatttcgaataacttcatctaatgatacacttgtcctcaatggggaaggtaatgtaatcaatggcaagtcatcaaatcgtttacctgcatgagtagcgatcttctgtaatgttgcagatctcattaggcctgctactcctggcgcgtcccacgccatagagcttcgataaactttcgaagcctcaaaccagttctcagaaggatcatcaaatcttagtttttcattgccatagactacatcaaccaaattagtggcatgcctttcaatctctttcatttcgttaacccctttcaccttagtatttatgggaatggatgaggtactggattaagtgtttcgattgtaaacggctctggtactaaccctaaatcgtaagaatgtcgtaatatacgttctccacccaacattcttcccctgtaaaggacatctataggtttaaaccctggaatgatggactttactacataagctccggcatcttttatatcaggacttgttaaatcaaatgtagccactttgaaacctttttcatataggtgatcatttagactattccaaagtacatcaggagaactatcatcgaatgacttaaattggttaacatcaactaaagtgctgttacttgtaaggaaatcagcttccttgacgatatcggttcctgcgtaaagcttgatatggtcctcaaaactattgatatccctattaaaatccgcattcactaatgcgttacctaaacgttgttccgtcttgacccaagttcttgtatacatcccttcaattgctgccttttcacaagccctttctattgaataggaggaggcggctccaattgcaaaaggggctaaattcgtatgaggatttctgacaactgctagcacagaaggaatacctgaaaatacagtcatatcaactaagtgcagccgcaatgatgttggtttaatatatctttcataaaagcgttttaatctcggagaagaattcacatcaatctggggcaagctcagcttgttataccaggtaagcataaaagcatcccgttcaatcgtttcaaataaacctgaaattgctgcttctacaaaggtaattccgcaagcaagaccgttacttgtagcatgacctatattagtgtccccaggccattccgtatgattggcgatatggattagttgccctggggtccatacctcctcatttgttttcgcatatgtcccttttctccaccacagcttagtattttcatcccaaacttcatgaggaaatataggatctttgaattgagttggagcgtacaattcccaatctttatatccaatgaaacgcttattctccttctctaattccttttgtgatccaaaacatacaacatcggaatcaaatggaagataagctgcactatatctttccaccgtttccccaatagcagctagtcttgccgcagccgcattatccgatccgcctccattataagaattagaggggactccgaataaaattttactgtctgtcccatgagcaccgtacgagtgtccccaaacgtcatctacatcgcgtaatttccgatactctcttctcactatacctacatatggatcagcaagactatcaaggactttccatgaatcttctaatgtcgtccatttactcaccataattatttgggcacctcgccgtgataccatacttgaggaaatcctgtgtcagcggcaggagaacacttttggcatctcggtactctatatacacgatgattatcaaccgaaactcccctgtcatccaaattgacagttataaaaccacctggaacggcgcttggtgcatagtctcttagtgtaatccactctgtgacaagattattcgctattcctgcctgtaccaaatgaactggctgattatataccggttgtttcgcagcgttgactggcttgaccttcatcaattctgaacgaaatacctcatctgaaaagtttgctgatttacgtaagttataacaatggagacatgcagacttgtgcgggatgaaaaatggaccaacccaagctgtctgaccatcgtatggaataacacacaaccaagggacatgatcttctaatgattgatcatttacttgttctaacagcgggtccaaatgtgaagctgctacagcaatacgtatcgaaggcttcccattatccggtttttctttccaatctatgtttaatcctgtttcctgcaagctattagtaagggttattgctaggttattttccccatgtgctacaacttccactatgcttgtctttaatctatgtaagatctggttgactttcacttgcccccctgccctctcatatgccaaaaaagcagtcatgtcaaaattagaagtagattgtatacacaatccgttcgtcaccaggaaatcgaagacgtttcttaactgttctttctctaagttgaacctttggtgcagttcttcaattgagactccattctcacatacaagatattctgaaattgcctcaaagaattcaacgattccttctccatcaacttttgtaatggattgtgctttaaagcttaacaggcttccttccaattctcccaaagtaatatgaggagataatttgaaccttacaaccgtttgaatagattgagtttgttgagacatctgtattcctccttaattaatttgtttattttcaaataattgagctgcatttggcggatgcccaattatctgttccagaatattagtagttggttctaatcggtcatcggaagacagtatctgatattctaccaaccattctattagatccagtggcatgttattttgcatcagcatcctaatcgcttcctctttatttttacattgtaaatctatctgcatctccaaatcttgttcaaatatatctttaagtctttccatactaataacttccgctccggttaggtcaaaggctttccctgcgcgaacatttacatctttttttgagattaagcatgcagatgcaacatcttgagtggaaatccaatttacgcctaccggagaaaaagcagtgagcagtattcctgtggctgctgcccatcctctgtacaactcgattccgatatccaaaggggatgttctgtataaaatactttttttatatttttgtagtaactctgtttccacgtaacccaattcatcattcaaattatatctccggtttgaaagtatgattgtttctgcatccaagtcaaaagagttgatgaaagaatcactttcgtactttattgatccgcctaaatctacaatctgcaatggataatcatggagctcagccgccttatcctccaatatttgtttcaggggttccctaactcccatgtagtgaattttcacgtccaatacctcctaatcaataatctcactcgatcaatctcatgatttgtcatcagaaagataagcaaaaagttaatataaccaattaatacttaatatggaaattataaatttgataatcaccgtaaataaatgtcttaacaaaagatggttgaaccataacagttaggacagtgcagcagcaaatagaaaacagcatacaagattaagttagttaggatcagaagttaaatacctttcttaaaagtaaacaaaggatggtgtcttgagaaaaacaaataagttaataacgtattacttcctcctactttagcctggttcatctctctgcgacaaaataatacagggagttacgaatacacaaatatcattaaatcagttattgattttgtaatactatctgaagaagcttcgaagaatgctgaggtaatacaaagaagagtaaatctttcgtaggtgacaccagaatcattacaataccaatggggtacaagaaacccttagtaaatttaagctttattctaagcagtcgggcagtcatcccttttgtccaacagacaaagctcaagcttccttgaagtttgacatttcctgttaagaatccacccaaagccccgatcagcctatgcgattcgcctgaattggcttagctttaacttcaaacaacgtttcctttttcctaacaagttgggttattccgcttaaaaaatagtatttattcccataaccctattaaaacacatactttccctctgatcaaatataaaattcagaattattaatttcatttttaactaaatttagagtgattcagcttcttaaaccaaattgctcattataaatccattatctatatcacaaaaaattacatatttgggttgacaatattgtccatataaatcacaatatggtacatatcggtaaattctttgtcgataaattttatggaggaggtaacaattatgactcaaattaaagtgccaactgctcttattgcaagtgtacacggagaaggtcaacatttattcgagccaatggctgcacgctgtacctgtaccacaatcatctctagttcatctacgttttaacctctaagacaaatagaccaataagatgattcttattggtctatgcttctttatattaaatttaaattaattctactgaatgtaatgaagtcccctcttcttgcagtatacggtatgttgttttatccattttgcctcctgtaattttaacgtttgcaatatcacaagattcaaaccgaatattaattagattgcagttcgtaaaggatactttctttagatagcagttcttgaagaacgtatgcaggatggaggtatctgtaaaattgacttttggcaggtgacaaccgatataaagcatatactcaagtttacatgtgtcataatttgactggctgagatcactttttttaaatgtcgattctatgatggcggagtctttacatgagaaattcttgaagtagcagtttttgaagacagagtgttcgacatcgatattctgaagagttgcacttttaaagtcactgagatagtactcggcatttaccggctcaaaatcctccgttttttgcaaattcttatttataaacgtcttttttttgagttttaatacattggatttatctatattcaggtcactggtatcgaccgccaagcttttggattctatttcgcgtataagcaacttctcaatatccagctttgtcataccctctgcttccaagctaatacttctatcatgaagcttagttaaaagctccgttttttttctgctcagtaacgaatttctttcgtactttttaaatagaccctcgacatacagttttagtttttcacttatcatttcccgctctccttttagtcccagctgcgttttaatgacccattcttcagcggtctagtttcttgccattttaatgtaatgccggtatccaattagagaaactataaatcccagtattgtatagctcagtacaacaagggttacccatattagactttctcctcccgatatcgtcgagaccgattgaattaacccttgatgcgcccagtactgcggaaagagcattccaatagtttgaagatagcttggtaattgatcataaggggtccataaaccgcatacaacagcggtacctaatgcaatcacatttgtcatgaccaaaccggtattttcagtctttgcaaagactgaaatggcaactccccaggatgtaactagtaaagatatcaacacaacaacccacatatacgccggaaaattattaatttcaatatcatacagaaatattcccagaacggacaggagaagaatttgcataaaagttatgactaaaaaagggatactttttcctaagaagaagttataaggctttaaaggggtacttgccagtcttgatacaattcctttttcccgatcctttacaaaacttataacgatggagataataatgaatgtagaaaagaatacgctcataccggttacagattgtgaagctactaaagttttgtttgtactgtctgtcgtaaatagctcaatcagcaatatgatggacacaataggtaatataatcgtccaaaaaaacagagacttatcctttaactgttttagcgtttcaatttgagcgagcggtaacatgataaattccccctttattcttcatcacgcaaatcagtgccggtaagtttaaagaatacatcttctaattttggcttatataaaaacaactgatgaggcacaatattgttttccttactgacgctaattaagcgctccatggtttctaaaggttttttggtttttattatcagccctgaattaacgactgaaaactcaaaaccatggctctttattaattcatgagacaatgaggagttaaacataatagatgattcttcatgtcgtttaagcagttcatttatttctccttcatcgataatctgccctctgtcgataaaagctacatagtcacaaagagtttcaatctcttccatgtaatggctcacataaataatggttttaccggcttttttgagtcgatttacgatgttaaaaatgtagcggcgtgattgcggatccacgcctaccgtcggctcatctagaataattaagtctggatcgtgcattagtgcacacccgatatttaaacggcgcttcattcctccggaaaagttctccacaacgtcgtttgccctttctgacaacccgatatcttctaacagtttttttgttgtttgctttagttttaagccattcagtccatgcacctttccaaaaaattccatgttggtctttgcggttaatttttcttcaaggctgatatcctgtggaacataacccagtctgccatttttattgccgacaaattcaatcttaccgtcatattcccggatgatgcgcgagatgatcttaattaaggtagatttaccggatccgttcggtccaacaagtccataacagactcctttcggaattgttaaagccacattgtccaaagccagagtcgtgccatagcgcttacttatatgttcaacttgcagcatttacaccattcccccactgttatttattttaaatatggattcaattgtattaatgtactccttgtaggctgctttcccttctttcgtaatctgaacaatagtcttcggctttttggatacgaacttcttggttagttctatataagctgcatcttctaactttttcagatgcgaacctaaattcccatctgtgatgtctaatgactttttcaggaaagtaaaatcacattgatcataagtcatcagtaaactcataattcccaaccgtactttggcatgtattaaatcattgatattgttaacattactcatttccttgcccttttcttttcaaaatcattcctgtaagtaataggctgcctccgccaataaatgcaaaaacaatattcattgcctcaggaaataaacagaatgtaagcataccgagtatgctcagccaaaatcccataataaaaatctcttttgttaacacgatgcctaagaatatgtacataatagacaccattaacacaatcaaaaacgatagaaattctcctgttcgcggcaataatcccattaaaatcaggaaaacaaaaatgcataccattaatatgaatccaatccatgcatattttaattgattctttaagaaagtgggcatgggatcaaattgtttctgcttaagatatgtcttcaaagtcagtatccaccctaatactgccagtattaaccagacacaagcaaggactacagaaggtaccttacataaagaaacggagtacgcaataatccatatacagccccaaataatgaaatatggactggtttgccttgagtactcagtcttgtagttcgtcaagaccttgatatgagataagttttcagctatctctgattctcgaaaattctgatttgacataagacaggctcctctttttacaaagtactttgtgaaacagagtatattctaattccatatatttgtaaagaggttttatccaaaataggcgcaactatttagtcttggaaacagcagatgggactcttggcgctgatatccttccaccactgtgagacatccttatcttgttataatatctcacaacaaagccttcagattgctgacaaaccgaatgtatatcgattggaaagcaattcattttcttgaaggaaaaaggactggagtcatccagtccttttcatcaaatcggtcaaatccccgcccaaacatcttttgcgtaaatgccttttgtctggaggtccaaaagccattcttgcgcttgccgttcgtctgtttcgtggaccgactgatacgctttttgcagcgttgcctctacatcgggcgccattttgctgccgtcgccgcatacgtagaggtgccctccccggccgaggatggaaattaaagcgccggcgtctttcgccattaagtgctgcacatacgttttcggtacgccttctttgcgggagaaagccgtatgaagcgtcacgattccgtctttttcataagcttcaagctcgtcacggtaaataaaatcatgatcgtttctgcatccgaaatacagatgagcctcccccagctcttttccttctttttttaacgccgcgcgggcttgcagaaatccgcggaacggggcgactcctgtgccgggaccgaccataataatcggtttttccggatcttccggcagccggaatcgtgtttccggagtgcggacaaacatcacgataccatcctcagggccgcggtccgctaaataattcgaagcgactccgcgatactcacccaaaccgctccgggcggggccgcgaacgacgccgacggtaattgaagcctgcccgggatgtttccggggcgaacttgaaatcgaataataccgcggcttcagcggacgcaaaagctccagaaatcgctcaaacggaagttcacacgcttcatatttttcaaggagatcgagcatcgagacgcgcgatgttaagatttgctcctgatagacgccctcctcaagaaaatcttccaattcccgtttgtgcggcgggcagaccgtataagcagccatttcccggatttgagcccttgatgccgcttcctgcaattcgacacagctgctcagaagatcatgcagcctgaccggccgatcgagcgggagatgaaccgcgctctgtccgctggccgtcagcagcacttgatcattcccgttcagattgaaccggcggagaacacggctgacctgctctttgctgtttaccggcagcacgccgagatgatccccttcattataggcagcctctttcggcagagtgatttcgatatgccttgtgctccggccgctttccggcgcctgaagttccctgttttccgcaacggatgcgtaaaccgcttcatacgtctgtgccaaaggagacccgccaagcccgctgacaaattgaaggcccagcgcacttcgctctttttcggcattttcattcagcttgagaccgaatgccttcatggcgtccgtccacatgctttttttccattcatcaagctttccttcaaaatcgccgctgacgtccccctcgcctcgagaggaaaagcgttccgcccctttttcggcaagcttctcatcaataagcctcggtacagcctgatatgtcgccgcccagttatgatcaccgcagccgaagacggcataccggacgccttccagctccccgggtttgacttcttcaagccattgaacgaattgtcccgcgttgctcggaggctttccgttataagaggacgtaatgatcaagagagctccttctttcggcagttttccgatccggtcatttaaaggcgccgtttcagtccggacgccgtgcatcccggcagtatcggcaagctcccgcgccacgccttctgcggttcccgtatctgatccgtacagaatcagaagcggtcggttatcaagcccgataatggatgcgccttttgtttcccgtttttctttttcgacgtcttccgacgctttttcagccgccgggagagcagccgcaacggcttctttgtttctcggccgcacccggatatgaaagtcgccgggcttgatcgtcagtgtctgtttaatatcgagctcataatcggtgtgatcgataaaggtaaaatgctgcagaatcatccccagaacaagagttgcttcatgcagggcgaactgcataccgatacacgccctctgaccgtttccgaacggcttatacgcatggtgaggcacttgatcaggatgttcaaaccgctccggataaaattcctccgcattgtctccccacgcgtctttatcacggtgaagctggggaattaagacggaaattctgtctttcggcgtgatcggatatttcccgccgatcaccgtatcctctttcgcataaaggctgaacgcaggcgcggtcggccataaacgcaatgactcctgcaaaatcattcggatataagtaagatccagcacttgtttatatgaaggaacgggatcggtcaatacccgatcagcttcctcataggctttttccaaaacacggggatgtttcagcagaaagtagatggcaaaggaaagcaggccgctggtcgtttcgtggccggcaattaaaaacgtgatgatttgaaaccggatattttcatcatcaagtttttcgcccgtttccgggtcttccacattcagcattctggccagcagatccttttcatcccggccgcctgaccggcgctctgcaataatactgtctactaacgaaaacatcgcctgaatgtcatgatgaaattggcgcttcgtcctgatcataagcttatcctgaacatcaaggcgctgcatttggtgcatcgcttcatcaagggcgcgcaccatgctgttgataaacggatgaggcgtttccctgtaatagctgttaaaccgatagttaaagccgcaaagcccgatcgtatcgagcgtcaggcgggtcatatcagcaggcacatcaacggcctcatccgggttcagcctagcccatttttgaatcagctgcaccgcgatatcagtcatcatcgaatgataatctttcatcgcgcgctggctgaaggtcggcatcagaatattatgcgcctttcgccagttaggctcatgcgtccagcttgtaaacagcccgtcaccggaaaacgcccggactttctccaaagccccttcaatgcttttatcgaaccgctcttcatcacaaacctctttcaccagttcatggccggacacgacgataatggcgcccgccggcgtatgcagctgaaaaataggcccctgctcgtttgccagtttgataagcgacattgtaggcttgtctttatcaagcaaaggaagattgccgagcgggccgaatgtcttcggctgcggaatcggacctgtttccttcatgaataacaccctttctaacacattgatgcgttccttccaactacattgcccttttcaccggccgattatccgccgtcacggatcaatcatcggattgacgatcgataacggttttttctatactggagaggcttgtcaaatacagaaataaggtgagttcacatatggattttgaaatcaagtttttatcgttttatgtcattcaagtggaaggaaaagatgaacaggcaaacaaacagttcaaacatttccagacccttgacacggaagaatttgaagaaagcgagctgaaggattttcttgacggggaattgaagaaaatcgtcaaacggaaagccgaacggcatccgcaatccgagcaagtcccaacaaaaatcggccattttatcacggagccgggccatgagcttgattcaaatccgaattacaaccttttcaaccgcgccagacttgcggatacgaaggaagcatttatcgaagcaagcgagcagttcgtccgcacttaccttgacacgagcgctgtgcgcggcggtgtttttatcgtggcatcggccgttccgcgcaagtattttgaagacaaattcgtctttatgatgaaatgcgatttcgagccgaaggtcgcccgcatctcagacgcctcgtctctcattaaaaaggtcgaaatggccatcacgacaaaaaacatgaaaagcattcaatatccgtatatgccggaagaaggcatgacggaagagcatgagctgaaaatccaccaggcctcgcacgcccgttatttcgaagattttctcaaatttgtcgaatacggcgaatcgatgccggaaatcatgaaaaaccaagtcatgaacatggtgcaggagcacgtgtatgaaaattttgaagaaaacagcgaagagcttcagcagtttgagcacgacattgaaatttgggaagcgagtgaaaagcgggaaattcaggagcgcctcgacacccatcaagtcatcgaggcatccgcgcagatcattgaacacacgccggaagccgagctgaaaatgaaagtcggagaaacagagattaaaggattactggctgatttcggtgaatccatccatctcgcaaaagtgaacgggcgctatgtcgcgctcattgaggcggaaacgatctcgtttgaaaaaggcagttcgccggtggagtttcacaagcctgaggggctgcatgaggtgattgaacggatacggaataaatctgaacaagactgacaaaagtccagacgccatgttctggactttctttatttaataaggctctttgagcaatcgatagcatgcaccgatgatgtcttggactccgggcgttccctttatctcgcggcggacgatttcagatgatagattctgcacctgtaatgcccgctccgcccgtctttcgaagtatgcttgacatgcagtttcatggttttcgtgtttttgcagttcttcactaagcacaatcgcgtcttcaatcgccatcgccgctccctgcgccaatgtcggcgctcctgcatggacggcatccccgcccagaacgacgcggcctctgtgccacggttctttgaccgccatctgctcaatcttatgaaacaaaacgggatattcctttgacatattctctgtcacaaacttcactcccggaattccgcgcagcaagtctttcacccgttcaaaacgcgtgtcctcgtcatccctgaagtcagcgtcatacggccggatgataaatacgtatcctgttttttcagagagcggcacgactccgacctgcgtctgcccttttttatacatcagtgttgaatcatgaaatatcggctcgggaaaagaaatgtaaaatctgtgcgctcccatgccgagatactctgttttcacttctctttgcagcatttgatcgcggacagcggagcggatgccgtcaaagccggcgagaatgtcagccgtcatcatggttccgtctgcacaatgcaccgttatttcatctgccgtttcttcgtaagacacgacttttttaccgagcagaatcgtgccccccgccgcttcagcatgctttttgaggatatcgtttaacgtttgccgcaatatattattccgccccggcaatgaatcatctaaaaacgcctcactcactttaaactgcagcgttccgttttcatcatgctgcttcagccattccgtttgaaagccgtgttgacagcattcatcatacacaccgatttcccgaagcacccgcagcgcattttgaggctggagaatgcccgctccgctttttcgcatgccggacgccgcctcgcaaagggtcacttcaaaacccgctctgccgagagaaatcgctgcggacaggccgccgatccctccgcccgctatgatgatctttttcacttcatggttcatcacgataccgccttctctatttatttatcacttattaactattagccaccttactatataggctgaaaaactgtcaatctttataagttgccttttgaatccggcaagcttatactttgaatcactaaaatggtacggaggcttacaaaaatggagttgagacatttgccggattactcgcagattgccggacgcgctgagatttacgccgatatggatgctgaatcattgaaaacatttttgacgttatttgatatgtctaaaaaaatgaatcaggtcatggagcattatttctcaagtcacggattgtccgaagggaaattcaaaattttaatgtttctgtttgacgcacccggacacagcctgagtccgacagagctggcgaaaaaatccaacgtcaccaaagcgaccatcaccggattgatcgacggactcgcacgggacggctttgtaaaccgcagccggcataccggcgacagacgaaaaatcagcatcgaactcacaaaagaaggaaaagaaaagctgatgctgtttcttcccggccacttctccaacatttcaggagtcatggaaagcttcaccgctgaacaaaaagcggaattgacaaaaatgcttgaagtattatttgataagcttctgctgttttccggcggcagaacataaagtagtatcgtaaaaacaaaggcaaatttctatgagatggaaattgaagtaaaaagatgagggttatacaaaacagcctgcacatttgtttgttcaggctgtttcagaagaaataattttaaaattactttctcttcactataaatgcaggtgttttaatgctggaagttacatttgtatatcgatttttagtcttcaacctcactctcacactatttgatcctttttttaacgatttttgatttgagagtttaaatacttttttaggtgttgagtgactgaaagaacctttctttgtttcattagccacccattttgaaccgttccaaacatcaattgtcatggaataatcaaatgttgcgattgtcccgcccccatatgatgctacacaatcaatggaagtagcttttgcagaataagaatccgcatcggtacaaactcttaatacatatgttgcataatctgtactacaaggcataatatccttcccctttcaaattttttgaaacaggcttgttattatgacaaaccctccgttcacttctagctggcaaacgtatgacaaaggggatctcatggcttaggagagtaaaaattcaaaactcttagaaattaacaaaaggcgcccctctcagcagggcgcctttttcgcgcggttaatcatcactgtttaaaattccgaaaaaccgtagcaggttgataaacaagttaataaagtcgatataaagcgtcaatgccatcaaaggaatcaggtcagccgtgatgtcccggtgcttgatctggttcagatcgtataagatgtacattgaaaacacaatcgtcccgatgacggaatacgccatcatggcggcggaattcagcgggctgaaaatattaaagatccccactgcgagaagtgcgataacagcgacgagcaagaaggaccataaaaatgacaagtcctttttcgtcttagcgccgatcgtgccgagcaccgcaaaaatcacaaacgatgaaccgaatgcctccaatacgacataggcccccgccgcggacgcataatggctgataatcggaaacagcgtcattccggaaatgaaagcgaatgaaaagacaaacacatatccgacggctttttttcggcgcagccaaaatgcggcgatgatcatgacgacctctaagaccgacagcggcagcatcaatgccggcggaatgaacttgcccgtatacaggccgattgtcgcaactaacagtgtaaacacaaataccgttataatgcgctgcataatagattgtttgctctcataagcagcagtttgcatgtcaaaagtcctcccaaaaaaatgatcttgataggtctattataaataaaatgggagaaatttgtatgattttaagaagattttaaggatgtcaggcctgacgttttgctgcgcattcctgcatatccatgaaatcatgcagttttttcgtcaagccgccgtgcccgaatcggatcttccccttctgccccggcgttttcgcgaaatcgagaaatgccagcacataaagacgcctgacgggaatcggaatgacgcccgcatcataaaaccagccgtcaattgtattgagcacgcctttgttaataccgtattgcttcgtgcaccaatgcagaaagcgcacttcgggcaggtgcagataccggctctcccggaaaggaacagttgaatgcttcatatgtaccgcctcctgtcattggctgttttttaagattgttttacttctttgctcttcagggaaaatcgatatttctccaccttatcaatttgtgtcacttgggaattatgaaccgtaatctgaactgtcccgaaatcgagcgtttccagcgcgctgataatcttttcgatcacatgcggatctacgtttcctttggacgtcatcatgctccccctttatgtctggccgttcgtcttttgacaatgagtgttttaattcatactattctgataagaaatatataattatactattatgttttcattcagaaatcaataacatttacacaatttttggatatgttttctttgcgaaaactgtcacttccttcgctttgatttaaaccgtgtcatcccgaaatcgactcccaaggcgtcatatagctgtttttaagaacgcaatcttcaagttccgacatatttacattgttttccgctgacaaaaaaagcgccccgcctctggacggagcacccttttttctatgcttttgcttcctcgatcacacatgtgacacccatgctggcgagcgcctgctccagggagccgtaagtttgatactctgaaaaatcaagccccaattggatagaagtctgtgccacatcaggccgaatgccggaaaacacggttctgatgccgaggagaaataacgttttcgacagcatatacaattgctgcgccaccatcgtatcgacaatgggcacaccggacagatcaatcacaaggtttgtgatccgtttggcgacacagttttccggcaccgactccaaaatcacgcgtgcccgtctcgtatcaatcgagccgatgagcggcagagtgccgatcgtatccgcgatcaaaataaccggacagctcaattcggaaataagctcctgctgagatgacagcctcgcgatcattaatttctgaaactgttcagtaaaatccgtcatcagctgatcaaacgagccgttgacaaggtgattccagcggcgggcatcctcgtttgttacgatgtcctgatgctcatccataaaacgggtgaccgcctcccaaaagacggttcttgaattgccgatcgcctcaacgacctcatgaacctccgcgtcttgctccactctgcttttcgctacctgtgcggcccatttttctttgttatgctgaaaaacggccggatcctccaaaaaagcgcttgcgatgaccgtgtttgtaaaggtatgctgctcgatcagcagccgtttcatttcctcacttaattgatccgcagaataaaaacgccctctcagcttccgtctcagcttgagccatttttccgtcagctctgccgaatgtgtaataatataatcatgaagtaattggtctttgttcactgccgtctcctctttcaagaatatgtacttttgtctaaattataaatcggaatcgccgatcgtactagagaaattaaaaaaagcctgcacattaaagctgttgattgcttttttcggcaggaggatacactataaaagaaatgaaacaggaggtcagtatgatgatcaaaaaaatcgcaacagtcgccgtatacactgatgatcagcaaaaagcgaaaacattctggacggaaaaagcggggtttgaaaccgtagccgagcatccgatggacccgggcgccttctggcttgaggtagcgcccaaaggggccgccactcatttggtgatttatccgaaatcaatgatgaaaggggccgagcatatgaaggcttctatcgtatttgagtgtgaagatgtctttgccgcatacgaacagatgaaaaagaacggcatcacctttttagatgaaccgaaacaaatggaatggggcagcttcgtgcaatttaaagatgaggatggtcatgtctttctcctgaaatcgtaatccgtcaggcatctcaattgactgtgagaatcattttcatttaaaatgttggataaagcgtgaaaaggattggagagttgccagatgttcgtgcaaatcagaaaaatgaccgtaaaagaaggacatgccgacaaagtaatcgaacgcttcagttcagaaggcgtgattgaaaagcaggaaggtttgatagacgtaacggtcctggaaaaaaaagtccgccgcggtgatgaagaagtcgtcgtgttaatccgctgggagtcagaagaccattggaaacaatgggaaaaaagcgaagaccacatcgcggcccacaaagcaaaccaaggcaagccgaaacctgattatatgcttgggacggatgtcggtatgtatcatgtcagagccgttaaaacaggcgtacacgaaaaataataaagagcatttgccccagggcaatgctctttttattttttctcctcatacggcaggacaaacagcggtttatcgggcttccattccgcatacagcacgtcctccgttcttttgatgttcagctttttcagctcctgagtcagctgcttttcttccagcccggcttctttcagattttcatacagcacttcgccgtcaataatcagcgtgaccggcaaagagacctgcttcggctttatttgcatgtcgccgtttttcgtcgtgtcatattgaaatttcggcaggacactgaccatcccgtttgtttctaaaatcgcgtactccgcttcctgtatggaaaagcaattcgcctgtctgagaaggctttgcaattgattaatgtccagcttattctttttcagcacatcatatttcagttttcctttatgtatgataatactcggctcgccttccaacagctttctggagctttttactttctgcgtaatcagttcgatgagataaattaaaaccccccataacagagaggcaaaaatgatttcaaaaatcctgacgcctttatcatacaccgcatttccgaccagttcgccgaggatgagcgcggaaataaaatcaaacggcgtaatttgcgagaattgagtttttccaagcaattttaaaatcacaaataaaatacccaaaccgcatactaactcccaagccactgtaagtaaatgtcccatattcgcaccttcttcttaaaagtcattaccattatggacattcgcctgttttctatacagcggccggcaacacacaaaaaaacgcagccgaggccgcgttttttcacttctgcttactgtttttgattcgatctgacgacccgtaagcacacctcagcggcataaccggcagccgctccggaacccgcaaacatcgcggcaagccccaagcccattccttcccagccgccgacaccgaaaatgctgtaaacaaccgtaccgaaagcagtcaggcccagcaccgccaaaaggcactcaggccacatctttttcggccatttcttgcggagcacagccgatacggcaaagttaagacaaaatgcggccagacagatcagaaaaaaaaaccccatgtcttttgcacctccgtcatgagtagctttttatttgctcacctttttttcaaacaaatgataacccggcgcgggtccttttgattcgtaccccattccgctgtaaaacgactgaagcgccttgttttcggacacgcaatcgagccggattttcgtttttcccggacaagacacacccgtctccgcccaagtcatgattgtccggccgagccccgcccctgcaaaccgcctgttaatcgccagccggtggagatatacggactcctcatgtccttcatcgccccaaagacgtctgtcccacccgcttgcttcgggaagcagcatgacgacgccggccagctcttcattctgcctgaataaaaaaacatacccttgggcgatcgcctcccgcatattgtgggtatcttccccttgcagaaggccgctccactggttcgaccctttatcgcgaagccattctgccgcttgcacgagcagatccatgacctcttttgcatcatctttccgggcgggggtgacccggaatgcccccgccgtctcctccgtaatcgtaaaaggtgtcataaaatcctcctgtaatcagaatattcgacacctttattatagaccaaacgcagaaaggaaaaaaacagccatcgtgtttgagggccgtttaaaaaattttcttcttatcacgttcttcttttaaaatctcaaccgcttccctgaaacgcatagagtggacgatttcacgctcacgcagaaaacggagtgaatcattcaggtcaggatcatcggaaatatcaataatccattgatacgtcgctctcgccttttcttcagccgcaatatcctcatataaatcagcgatcggatctcccttcgcctgtatgtaagacgctgtgaacggaactccggccgcattgtgataaaacagcgcgctgtcatggttgacgtaatgatcactgagccctgcatcacgcagctgctccggggtcgcatcttttgtcagcttataaatcatcgtcgcaatcatttctaaatgcgcaaactcctccgtgccgatatccgtcagcaggccgatcaccttgtcaggaatcgtgtagcgctggtttaagtaccggagcgctgcggccaattcgccgtccgccccgccgtattgttcaatgagaaacttagccagcatcgggttgcatgtactgactttaaccggatactgcagctttttttcatatacccacatttacagatccctccttatacttgccatggccaaggaccgcggccccagtcccattgagcgccgacctgactcacgccgaattgcagaagcggtccgtactcaggctcaaaccgctttctcagctgtcttgagtaccgggaatattcatgaaactgctgaagcgcgagacggtcatggggatgcgtatccagataaagcgtcagctccaccaagacaaagtccgccgcctgaatttgctccagcagccgataatattcatcatcaatctttttcgccatattcgattcccccccgataaggattatcatagaaatcgtaaagatccttccaaagggtcccttttctcaatgcctccatcggagaaaactgctctaagtgatacggctgaaaccgcatataaagatgcggcggcgttctgaagtattttctcccgatcggcgggcagggatcaaaccggctgtggaagggtttataggatttgaccggtgtaaacggctgattttctttcattacgatcctcctttcctaaacacatgaccttaataggtatgaatccgtatcggcatttatgccctgtaagaaaataaaaaagccagcgcttagaaacggtcacaaaaaaacactcttgctgttccaagagtgcttttcccgaatggtcagatatattggctgtcccgatgatgatgatgatgatagaacgggtagccgccatagccgccaaaaccgtaccccggatatcctccgtagcctccgtagccgccgtagccgccaaaaccgtaccccgggtagccatagccgccgccgaaaccgtatcccggatatcctccgaagccgccgtagccaccgtagcctccgtagcctccgtagccgccatagccgccgccgtaaatcggtcttctttcattcatgatttatcgctccttcacataggttacagtccagtttatgacatgcggaaggaaacgtatgggcatccgcccagttttggcgaaataatcaataattgcttacggagaaatacgatacaggccgaccgcataagcaaaattaaaaaggccggaacttatgccgccccggcctttttgtctttattcgcctaaatctacattgtgataaacctgctgtacgtcttcgaggtcttccagcacatcgatcagcttttcaaattgagctttcgcatcttccgggagctcgacttcattttgcgcaagcatcgtcagctccgcaaccgtgaactcttcaacgccggcatttttgaatgcctcctgcacggcatggaattggtcaggctcggcatacacgatcacactgtcatcctcttctaaaatatcgcgcacgtccacatcagcttccatcagcaattccagcgcttcatccgccgtcttgccttcaacgccgataacggcagtcgcatcgaacatgtaagcgacagacccgctcacacccatatttccgccgtttttcccgaatgcggcgcgcacttcaggcgccgtgcggtttacattattcgttaacgcatcaacgatgatcattgaaccgttcggcccgaaaccttcgtaacgcagctcgtcaaagttctcctccgcgccgcctttcgccttttcaatcgcacgctcaataatatttttcggcacactgtacgtcttcgcgcgctcaagcaccacttttaacgcctggttcgattccggatctggctcgccttgttttgccgccacataaatctcacggccgaacttcgcgtaaatccggctcgtatttgcgtccttcgatgctttcttttctttaatattgttccacttacggcccattttgttccactctctttcacgaattgaatctgtatgataaatactctgcttctattatacctcagcggttgggttgtttcgagtgtaagacattagaaaaaaacaggcacgcttaaaacagtaagccgaatgtgagggttattatacaaaacataaaaagcctcccttcatacaggaaggaagtcgcaagccaaaagattcattttattcttattacctatttcctacactgtatatcctgactcacgtggtaaaattttgatatcgaacaaaagaaaggatatggtcatgaaagttttcgaagcaaccaccctcctcgccgccgccaagcagcgcgcgggtgaatacaaagaactccgcggccaaatggtcaatctgaaaaaagcgtttcaaggtatggctgatcttggtgacaatgatttctcaggccggggcgcaaataacatcaaagctttttttaaggaccacgccggcgtcacagacagctggcttgatctgatcgacatgaaaatcgcatttctcacaagccttcccggcaaaatcgaagacgcaggtctttccggatctcatgtagaagaatcatttctggagcacgagctcacccacgccctcagtaaatcaaaggcaattatggaagagcagaaaaaggacatgcgctccatcctcggtgagatcgatgacatcatctcgcttgatctattttcaacggaaagcacagatcagaagctttcttcagctatcaaaaaaagaagcgaaacgatacataagctcggcaagcttgatcacgatctaacgaaagaatacgcagaaaccgaagcaaatgaacattttatccaagcagatttccagcagctccaaaacgctacaggcaaaggaaaaaacgccacgccgcttcactacaatgccaaggcgtaccgagaaagcgacatccataagaaaaaagacgagatttcaagacattcggatgcttatttgacgattaaaaaggaagaagcgaaagagcgtgagattgaaaaactgaaagaaagactgaaaaactacgattatgcgaatgccgatgaattctattcaatggccaaaacgatcggctataaaaacctgacaaaagaacagcagcgctacttcactcaaattgaaaacacgcgtgaacttacagacggtttcaaaggcgttgccgtcggcctttatgattccggaaaagacgcggtcacaggcctgtgggatatggtcacagatccgggcggaacggttgaagccattacaggagcggtggctcacccgatcaaaacgtatgaagccatttcagcggcaatcgaagaatcataccaaaaagacatggtgaatggcgacacctactccagagcaagatgggtgtcatatgcagtgggcaccgttgtgacatcagtcgtcggcacaaaaggcgtcggcgccgtctcaaaaacaggcacagccgccaaagtgacaaccaaagtcaaaacagcagcaagcaaatccgccacagctcaaaaagcgataacggtctcaaaacaaaccgttgatcacatcaaacaaaaagtaaacacaggcatcgaagtatcaaaaaaacgcgccaaaaccaagttaaatcaaatgggagatctcaccctggctgatattctcccgtatcatccgcgtcacgacttagtgccggcgggcgttccttacaacgcagtcaacggggtcacacttaaagaaggacttcagaaattcgccaaggtcatcctgccgaaaccgtacggaacctccgcaagcggcagacggacaccggcaccgcatgtaccgccggtaacggtcaaatacggcgagcattttgcgaaatggaccagaaagaaagtattgaagccgaatgtcatctacaaaacaaaagaaggctacacgtacaccactgacaactatggtagaattacaagtgtcaaagcagacttgcagctgggagaagcaaaacgcaaccaatatgcacagtcaaaagcaggtaaaccagaccgtctgacagatgacgacggaggccacctaatcgccacccaattcaaaggctcaggccaattcgacaacatcgtgccgatgaactctcagattaataggagcggcgggaaatggtatgagatggagcaagagtgggcaaaagccctaagcaaaaaaccacctaaaaaagtagcagttcaaatagaaccagtctattctggagattcacttagaccatcatatttcgatgtaacctacaaaattgggagcagaaaagaaataagcgtctctattaaaaatcagcgagggggttaacctaatggaaactaagagaatgcaagatttatatcaacttattggagaaaaactaaatgacattatacctggtgaatggacaaagatatatctttatgcagaagtattagatgattccacaatggttctttttcacttcagaacacccgaaaataatcaaattatttattcacaagatatacctagccattacaacgtaagcaaggacattttcaagacgttgttaagagaactaagagaactttttgaagaattaaaaactgaacacagaaataataacgatgatgtttggactaaccttacactaacattggatcgtagcggagaattccaattagattataattatgatgatattttagcatcagatttagatggatatgaaagaatcgcaatatgggaatatcaaaacttggggattttgcctgaagatgaggacgataaagaatttgtaataagctacttcggtctataaatcaataatggcccagcgcttctctgctgggctattttttataactaggatttttcgacaatcggagttgaaaagattggaaactaaaaaaatgcaagatttgtaccagcttattagtcagaaattaaatgacatcataccttgtgaatgggcaaaagtatatctttatgcagaagtattagatgactctaccatggtcctctttcacttcacgacaccagaaaaacatcaacttatttattcacaagatatatctgcccgatacagtgtaaataaaaatatcttcaacacttttcaagagaaatccgagaactctttagaattgagcacaaaaagaataatgataaacaaaacaggcagcatccagtaaacggatgctgcctgttacatcgttatgtatcgtctgaggaggtcatttattttgttttttaaatatgaaaatagatatgacggtaaatatgatggctgtaatgacaatgacccacaagctcgcagccgtactgataaaatggccgtttaacttgtagacgatcccgtaatgcttttcatattcctgtatttggtccgcagaagcatgtttaaatactttatcaactgagtctgtcataaacgcttttctgaacagaacagcggtgtggctgatagggaaatacataataatcttctgcacaaacaccggtacgccgccgatcggcacatatactccgcataaaaaaccgatggctgttccgacaatcgtacttaacgtcgaaaatgcattttgtgtgtgaataaacagcgttaaaaataaattaatggagcttgacagtgcaactgaaagaataataatccccaatacttcaagtatatctgtaccgcttaaaagtttgctgcctgatgaaacgagaaaaatttcacagcctaaaaaggcgatgaatgaaaagatcaagccgatgacaaatgaatgaatgacatagctcaattggatggtcgcccttgataaaggagctgttaaaaagtcatacgttctcttgctttctttatctttcaccataattccgaaagcgcctaaagtcgttgtcacagctgtaatggacagcaatcccgccaccatccattcgttcaccattgctttggaatcatctgtcgaaccgaccaaggccttaatggcgtccagctgtgtctgctgtaagaacacggcatataacagaatgacgataaatactgacagcaaagaaagaagcaaaagagttcgatcacggaagtatatttttatatttctgctgattaaactggataaagacttcatttatgcaatgctcccctttactggcaaactgcttccttgttcttcgataatatggataaacacatcatccatattccctttaatcacctcgaaagattcaatttttccttcaagacctttcaaaatgtcaaacgcttggagagtggactctacacgaagggaataaatagagtttttaaccgtaaaatccagttgtttattttcaaaccatgcagtcggatcaacgccttgcttaaacatcatatgcagactgtcaaacgcatattgatctttcagctgactcggtgtaccctctgcgatcagacgtccttctttgatgaccacaacgttatcagccacagcggcctcctccatgtaatgggtcgttaaaaagatcgtcatgtttgtttcttcctgcagccttttaatcgcattccaaacaaaaactctcgtttgcggatcaagacctgtagtaggctcatctaaaaataatattgtcggtttatggatgatggcacgggcaatatctgctcttcttctttgtccgcctgacaaatcgctgtattttttctccttaatatcatccaattttaaatagtctgttacaaactgatagttctcttgcacttgtgccttgcttaaatgataatattgtccgcggttcatgatattttcataaacggtcaatcgttcatccaaaatgctctcttggaaaacaactccgatctttttgcggatatgattattctctttcccctcaccaagcgtataaccgtctattaccacttttccggatgtctttttaatcagcgtacagagaatatcgatagtggtcgattttcctgcgccgttcgttcccagaaatgcaaacagctcgccgcgtttgacagaaaaggatacccctttcactgcttcaaatgatccatattttttacgaagatccgttactgtaataatgtcttgttcttctcccattctgttcacctcgaaaagtaagattctataccgttgttcactaactttatatcgtcattcccgccaggattttctcatttttatccaactttattatctttttataaataattataacgatataatttattattttcgcgttttgttattgggtttaggctcggtggattttctatacatagggatcacttattgattttgcatgaaacttatacatgctgtaatcaataaaccctttatcataaaaagggtttttattggttaagaatctctaatactatttaaaattcttgtttgtaaccgaaatacatattatcttagaatattcagaaaggagaacgtaatggaaacatgcccttattgtgcaacttcaattcaaaaggataatcagtattactgtagtttttgcttaatgtacatacataatgttcagagagatggcaaacgtgaaatcatagaatatcgtgagcatacttctgaattagatttggataagtctacaccagaactaatgactctgccaacaattgaattatttcatttactgcggctctcaagaaaaatacgcaaacagaagtatgatcagctatataaatctcgacttgaatcagaaaagggaaatgaatcagaaaatgttcaaatcgcaacggatagttaccaatattacacaaagaaaatgtatatcatagagaatatattaaataaacgtctgggttacattccggataggatagataatgtatttcttaagagttatttagaaaaagtaatgattagtaaggagaaaaaacaagatatgaaagtgtattaaaaaagctgcccctctagagtgaatattaataaagggttcctaaaaaggtaccctttattacataaagaggtgtatagaaagctatattataggcgtcaaccaaacatcttctggtactcctctcatgtcacgagttcgtcctgaatgcaaaaaaaatgcggattaaaaaaaggcaaccatccctaagggttagttgccttctcttaattccagcacagccacacactccacatgattcgtatgcgggaacatatccacaggctgcacttcgcgcgtcacgtacccgccatcctcaagcacccgcaggtctcttgcaagcgttcctggattgcaggatacgtacaccacccgcttcggtttcatctcgatgattgtccgcaggagggcttcgtcgcagccttttcttggcgggtcgacgacgagggtgtcggccgtgataccttctttataccatttcggaatgacggtttccgcttctccgactgcgaattccgcgtttgtgatgccattcagctcagcgttgcgttttgcatcctcgatggcttccggcacgatttcgacgccgtatactttcttcgcctgcttcgccagaaatagagaaatcgttccgatgccgcagtaggcgtcgatgacggtttcttccccttgcagctccgcgtactcaagcgctttgtcgtagagcacttttgtctgttccgggttgacctgatagaacgatctggcggagatggcgaatttgacgtctccgatgaggtcgtagatgtattcttcgccccagatgacgtttgtttcgttcccaaagatgacgtttgttttgtttaaattgatgttttgcacgatcgatttgacgtgcgggaattgcgccgtaatgtcttcgatgatcttcgctttgtgcggaaaatcgcttgttctagtgataaagacgatcatcatttcgcccgtgacgacgccgtatctgaccatgatgtggcggagccagcctttgtggcgttcttcgttataggctttgacgccgtatgaggcgcaaatgtctttgacggcttgaacggcttcgtcgtttttggattgctggatcatgcaggcgctcatgtcaatgatgtcatggcttctttgctgatagaatccggcgacgagtccgccttcccgttctcctaccggcacctgcgctttgtttctgtagttccacgggtcttccatgccgagcgtcggatgcacgatgacttttgaaaggttcagcttgccgatccgttctaagacgtctttgacttgtttctgtttaaacaagagctggccttcataggtcatgtgctgaagctggcagccgccgcattgtttgtagattgggcacggggcatccgttctgtgcgggctttcttccttcagctcgattaagcggccgaaagcgaagccttttttgacgcgtgtcactttgatttgcgctttttcctcaggcagggcgttcggcacgaaaatagggaagccctgaacctttgcgacgcccgctccttcgtgcgtcaaatcctcaaatgtcacatcatagtattcatttttttctatcgggggtttcattttcatctataatcacctctagttttaccaatagccttgtttcagcgtgctggcaaaccttcaaattcaatgtcagccttcaaaggtttccgatcacgctgaaaagatgacaaaatcctaaaacgaatactgttttaggattttgtccacgtattaatcatccagctgttccgctttctccttcggcatgatgacgtgaatatgccggtacaggttcacgaattcgcccggcagcatgccgccgtactcgccgtccaggttcagctgcatcttttctgatacattgactttcacacggttcgcttttgtgtaaataatgtgctgatcgttaatatgatcgcctctgagcgccatgctcgcgactctgataaactccgcgagattggcttttttcaaaataattaaatcaaacatgccgtcatttaggctggaatcaggggccagcttctcgaatccgccgaccgagttggtcagcgtcactaaaaacagcataatttcgccttgaaacagcttgccgtcatattcaatctcgacttctgtcggtcgaagtgaaggcagcatttccattccctttaaataataagcaagctggccgagcatcgttttcagtttgctcggcacatcatacgtcagctccgtcagacggcctccgccggcgatgttgataaaatactgaccgttcacctgtccgatgtcgatcgggcgggctacgccgttaatgacggtatcagcggcattcagtatattctctctcggaatgcccagcgctctggcgaagtcatttgtcgtgccgaccggaatgatgccgagtgtcgggcgtttgtctaacggcgcaaggccgttgacgacttcattaatcgttccgtctccgccggctgcgataatcaagtcaaactcccgcaaagcggcttcttttgcggcgttggtggcatcccccgcgcatgtggtggcatgggtggaggtttcataaccggcttgttcaaatttttgcaggacctgggcaagatttttcttaaaaagctcccgtcctgaagtcggattgtatattatgcgtgcacgtttcattatctcatcatcctacttaagagtatccgatccattattaacactaacaacctttaattatactatgacttgagaaaatcgcaacaatatgtacagaaattgccagaagaaaaaaggccccggctccgtttaaggagccaaggcccgctgtcttactcttcttccgttccaggttttttcttacgaaatttcgctaatacttcatatacgatcggcacaatcagaagggtaagcagagtcgaactgattaaaccgccgataacagtgacaccgagtcctttagaaatgacctggcttccgccttcgaagcccaatgccaatggaagcagggcgccgattgtcgcgatcgccgtcatcagaatcggacgcaatctcgtagagccggcttccaggagcgcttctctcgtcgataagccttccgcttctttatggatgacgcgatcaattaagacaatcgcatttgtgacgacgattccgatcagcatcagcataccgatcatggcattcagactgatcgtctctccggatacatacagtccggctaatgcgccgatgactgtaaacggaagcgagaacagaatcgcaaacggcgctaatgctccgccgaacgtgatcacaagaacgaggtatacgatggcgattgcggcaagcattgctaagccgagtttcgtaaaggaatcagctatatccgctgatacaccgccggtatcaatcgatacattgtccgggtgatccagtttgtcaactttcttttgaacggctgatgacaccttcgtgacgttgtcagaagtgacggttgccgttacgtcagcgtacactttgccgtcgcgtttggaaatggtatcggatgtcgtgccgtttttcactttcgccacatcgccgatttttacttcttggcctgcaggcgatgtgatggttttatcctctaattcttttacactcttatactggtctttttctgttttgatgttcacatcaagctctttgccgtcctttttcaccgttgtcaaaggagactgtgacgtttgggacatcagggcttgggagatttgcgaagccgtcaggcccttcttgctgagtttctcctggtcagcgacgaacgtgtactcatcatatgtgctggaaaggcctgagttgacgtctttcagatccttctgctttttcatgatgccttcgatgtctttgaccgtgcctttaatatcagactctgaatctccgtacacatagtacgttaattcgttgttgttgcctgacgaactgaaattttgtgatttccattcgccgcggctggatgtttttttgatttcttttaagacattgtctttttctttgtcaaaatcaggcgtgtcatcctcgtatttcacgtagaacaatgcgccgtttaagcttccgccgagcggactttgcgagcctaatgaatactgaacggtatcgacatgtttgcgtttaagcagcatgtcttccgctttttgcgcagctttttcagcttcgcttttcgtttcgcccggttcaggcgtgtatgtgagctgcatcgttttgtccgcttgcgcaggcaggtagctcgcgccgatcagaggtacgaggaacaaactgccgacaagcatcagaaccgcgatgatagatgtaatccatttatgtcttaatgaccaattcagcacttttttatagaaattggccaatctgcccggcttatgctctttcgctttaacaggcgcgcctgtgagcgattttttgaataagctgtgcgcaagcatcggcaccagtgtgatcgaaatcaacagcgatgcggcaagcgcgaagacgattgttaatgcaaacggcataaacagttcgccgatctgtccgccgaccatggcaagcggcaggaatacggcaatggttacgatcgttgatgacatgatcggtttaaacatttctttcgtcgcttcacgcaccaattgcttcccgcgtaaaggttcatctttcagcctcatgcggcggtaaatgttttcgatcacgacaatcgaatcatcgactacccgtccgatggcgaccgtcatcgcaccgagcgtcattatgttcaatgtgacatcaagctgattcagcacaagaagcgcaatcagcagtgacagcgggatggaaacgatagaaatcatcgttgatttaatatctcttaagaataagagaatgatcacgaccgcaaaaatcgcgccgaaaatcgctttgcttaacatcgtatccaccgactctgtaatcggctctgccatatcaagagtcgagctgtacttgaaccctttatggtcttttttgtattgattcagttcatctttaatcgcatcggccacttctaccgtgttggcgtcattggcttttacgatattaattccgatgctgtcctttccgttcgtgcgggaaatggattcagcttttttcacatctttaatgtcggcaatgtcagaaagcttgactgtcggcacccctgctgccgcgctttgctgtgcctgctgcatagcctgagcgtccgccgcagatgccgcaccggctccgcccgtttgaccttgagcggcagaagaagatgtgaccggaattctcatatctttcagatctttaattgacgtaatatctccgttaacgacaactgatttttctttgttgccgaacgtgtacaatccaagcggcgtattgacgtcagagccttggatcactttcttgacggtatcttcatcaagtccgtactctttcatttttttgtctttgaaagagaattccacctgctcttcctgctgtccggaaacttgcacggacgcaacgccctgaatgccttcaagcttaggtacgagagtgttttccacatttttggtcaggtcttcaagcgagcttttgccgcttgtcacactgagcgtcaaaatcgggaaagagttgaggctgtaacgggaaatgtcaggttttttcgcgtcgtcaggaaggctgacactgtccagcgcttcagcgacttcggttttcgccttgtccatatccttgttgtaatcatattcaatcataaccgatgagacgttttcagaggatgtggacgttacgacgctcactccttctaaattctggaccgcctgctcgatcggttttgtcacgtcatccgcaacttgactcggagcagctccgggataagtcgtatttactgaaaggtaaggcatgttgacgtccggtatggattcctgcttcatattcagaccggcatacagccctgctacagtaacgataatcgtcatcagccaaactgcgaatttgttcttcagtacaaagttaataatgtggttcatcatgtcctccgttaatttttattgactgactggtcattctatataatactaaacggtataactcaacatcgtcaactaataaggcagtaaatttttctaaatttttcaggattaaggggaagcacgtcatgaacgaaaaaaaagagaaaatcataaaaacaggcatccatttatttgccaaaaaagggttttcttcaacaaccattcaggaaatcgccggtgaatgcggaatttcaaaaggggccttctatctccatttcaaatcaaaagaagaccttttgctctcagcatgtgagtattacatcggcatgtctatggaagaaataaagaaaatcaaaacagaacatcaacataaaccgcctaaggacgtattccgaaaacaaatcgcatatcaattccaggaatttatggaacacaaggactttatcatcctcttgctgagcgaaaaggtcattcctgaaaatcaaaaggtcaaacagtattttcatgaggccaatattcaatttaacatgctgtatcgggatgcgttgctctccgtttacggagatgccgtcacaccgtttttagcggatgcgtccgttatggcgcaaggaattgtgagctcctatattcatttcttgatttttaatgaacatacggcattccggacggaaaacgtggcggcctttctgattgccagaatcgatgatctgattacggggctgataagagacaatcccgatccgctgctgcctgaggatatcttcactcagcccgcggcggacagagaaagactgcttgcggatattcaaaagattaaaacacagcaggagctgcctgaggacgtcctcgtatcgcttgaagtcattgaagaggaatgtgcaaaagaagagccgcgaaaaccgattattaaaggaatgctgtccaacttggcaggcagcggaaatgagcagattgaaatgctgcgggcttccattgaaacctatttcagcttataaaaaaaaagagaccggcgcttaccggtctccatgtcagcagcgcccttacaggcggctgcttttttttatcgttttttgatttcttcaagtaagatcttgttgaccatcggcgggttggcctgtccttttgaggctttcataatctgcccgacaaggaagccgatcgcgcggtcttttccgtttttgaagtcttcaattgactgcgggttgctgtcaagcgcatctgttaccagcttcagaagcacgctttcgtcagaaatctgaacaaggcctttttctttgacgattttttctgcgtcgccgcctttttcaattaattctttaaagactttcttcgcgattttggacgagatggttcctttttcaatcagcttaatcatgccggcaaggccttcaggagtcagtgcgacatcctcaagctctttttgttcggcgttcaggtaagctgagacttcacccatcagccagtttgatgcctgcttggcttctgcgcctttattgaccgtttcttcgaagaagtcagccatttctttcgtcagcgtcagaaccattgcgtcataagccggcaggccgagctcttcgatataacgcttgcggcgctcatccggaagctcaggaatggttgctcttacgcgttctttccattcgtcatcaatgtagagctcgacaaggtcaggctcagggaaataacgatagtcgtccgaaccttctttgacacgcatcaaaatggtttttttcgtcgcttcatcgtagcggcgcgtctcctgctgaatgactccgcctgacagaagcacctgctcttggcgtttttcttcatgctcaaggcctttttgcacgaatgcgaaagagttgaggtttttcagctccgtttttgtgccgaatttctcctggccgatcggacggagggaaatgttggcgtcacagcgcagtgaaccttcttccattttacagtcggaaacacctgtgtattggataattgatttcagcttttcgagatatgcgtaagcttcctccggtgtgcggatatccggctcagatacaatctcgacaagcggcgtgccctggcggttgaagtcaacgagggaatagccgtcgcccgtatgcgtcagttttcccgcatcttcttcaaggtgaagacgggtgatgccgatttttttcgtttttccgccgacttcgatttcgatccagccgttttcgccgattggcttgtcaaattgagaaatttgatatgccttcgggttgtccgggtagaaatagtttttccggtcaaacttcgtatccgttgcgatttcgcagttcaaagccattgcggctttcatcgcgaattcgaccgcttctttgttcaaaacgggcagcacgccgggatagccgaggtcgatgacgctcgtttgggtattcgcttccgcgccgaatggcgtcggtgagcttgagaaaattttagattttgtttttaattccacatggacttcaagtccgattaccgtttcaaagttcacttcatttcaccccttacagttcaggtttcgctttatgatgatctgttgcctgctcaaaagcatgagcgacgcggtatacagtgccttcatcgaagtgttttccgatgatttgcagtccgagcggcagtccgtccgcaaatccgcacggcacgctgattcccggcacacccgcgaggttgacagggatcgttaaaatatcgttggcgtacattgtgagcggatcgctggttttttcgccgattttgaatgccggtgtcggcgttgtcggtccgacgatgacatcgtatttctcaaatacgtcttcaaaatcttttttaataagcgtgcgcactttttgcgcttttttgtaatacgcgtcatagtagccggagctgagcgcgaaggtgccgagcatgatgcggcgcttcacttcgttgccgaagccttcagagcgtgtctgtttataaaggtcgatcaggttgtccgcattgtctgagcggtagccgtagcggatgccgtcaaagcgcgcaaggtttgcagacgcttcggaagaagacagcagataatacgtcgcaagcgcgtatttgctgtgcggcagagatacttcttcccatgtcgctccgaggtcttcaagcacttttaaagcggctaaaaccgattctttcgcttctttgccgacgccttctccgagatattctttcggtacggcgattttcaagcctttaatatcgccagttaatgaagaaagaaagtccggcacttcgacattggcgctcgtagagtccattttgtccgggcctgaaatcgcctgaagaaggaatgcgttatcttctacggttcttgtgatcggcccgatctggtccagtgaagacgcaaaagcgaccaaaccgtaacgcgacacacgtccgtatgtaggctttaatccgacgacgccgcagaaagaagccggctggcggatggagccgcccgtatcagatccgagtgaaaacgggacttcgcccgcggcaaccgcagctgcggaaccgccgcttgatccgccgggaaccgtatcgagattccaagggtttttcgtcgctttgtacgcggagttttcagtagaagaacccatcgcgaactcgtccatattcagctttccgatcgttacggcttcagcggcttgaaggcgctccacaaccgtcgcatcgtaaatcggatcgaagttttcgaggattttgcttgagcatgtggtgcgaagccctttggtcacgatgttgtctttgacgccgatcggcattccgaagagaagaccgtgttcagaccgtccgtcaaccgcttcgtcaagttctttcgcgtaagcgcgggctctttcttcatcaagctgtaaaaacgcctgcaccttatcatccacggatgcgatccgtttgtaagattcatcaacaagatcggaaatcttgatttcttttttatgtatcatttgtttcagttctgtgattttgtgatcaaataatgacatactgtctccctcctttaatccagaatagatggcacacggacatagccgtctttatgatcgggagcatttttcatgacatcctcgaccggaaggcctttacccgcttcatcttctctcattacgtttttcattttcagcacgtgtgttgtcggttccacgttatccgtgtccacttcattaagctcctcggcaaacgagatgatgctgtcaagctgttctgtaaacatttcagcttcttcatccgtaatggcgagtctcgccaaatgagcgacatgctttacttcttctatagaaattcgtgacataagatccacctccgcataattctccgtttcgtcatataatactgatcatatcaaaaacgagccctctaaagcaacaaaacgccgccttctgaggcatgatgaaaccctctctattttatcctaaatcggggagaaagagaaacgaattatatgtcagaaaatttttacttttataatttattggtagcgttttcatctctaagctgttctatgttggcggggattttttccttgagcgggccaggtttcgagagttgattgatcggggatactttgttaggtttagtaaccatagccagcactaaatcatgcgatccgcacggaatgatgactaaaggctggatcgccggcgcatattccggcactactaatctacagaggtgatgcaacatttacatgaaagaagagagggtccaaaaacgtgagtattgaattaattatatctcttggcatttactttgctgccatgctgttaatcggctggtacgcattcaggaagacaacgaatattaatgattacatgctgggcggaagaggacttggcccgttcgtaacggcgctgtccgcaggtgcggccgatatgagcgcatggatgctgatgggagttcccggcgcaatgttcgcaacggggttatcgaccttatggctggcgctcggtttgacgatcggcgcgtattcaaattatctgctgcttgctccgaggctgcgcgcttacacggaagttgcggatgatgcgattacgattcccgattttttcgataaacggttccgccactcgtcatcattgctgaaaattgtttccgccgtgattattatgatctttttcacactgtacacatcgtccgggatggtatccggaggcaggttatttgaatcggcattcggcgccgactacaaattcggtttgtttttaacggccggtgttgttgtgctttacacgctgtttggcggtttcctcgctgtcagtctgactgactttgtacagggagcgatcatgtttgcggcattagtgcttgtgccgatcgttgcttttacccagctcgggagcgtttcaacgacgattgattcgatcaacgccgttaacccgaaactattggatatctttaaaggcgcgagcgtcattagcattatttcttatttggcatggggactcggctattacggccagcctcatatcatcgtacgatttatggcgattaaagaagtgaaagatttaaaacccgcccgcagaatcgggatgagctggatggttatttcagttgtcggttcattgcttaccgggattatcggggttgcgtattctcatcacttcggagtctccgtaaaagatccggaaacgattttcattattttttctaaaatcttgttccatccgctgattacgggcttcttgctgtccgcgattttagcggcgatcatgagttccatttcctcacagcttctcgtaacggcaagcgccattacggaagatttataccgcgcctttttcagacgggaagcgagcgataaagaattggtcatgaccggacgcctgtcggtattgatcgtggccgttatcgccattttgctttccatgaatccgaacagcaccattcttgatctggtcggatatgcgtgggcaggcttcggttcggctatcggcccggcgctcttgctcagtctgtactggaaacggatgaatgaatggggagcgcttgcggcgatgattaccggggccgcggccgttttaatctggatcacgacagggcttgccgcttcaaccggcgtatacgaaatcattccggggttcttcctcagtctgattgccggtattgccgtcagcctgctgaccaaaaaaccggccgatgcttcttatcagctgttcagccggatggaagctcttttgaaaaacaagaaatagacaaaaagccgtcagattttatccctgacggcttttttcttccgcacttgtcctgctataaatactgtgagaaaatcatatcaatttattataagaaaaattgcggaggtgctgtgcaaattgagctggcctatcgaaccagacattttattaaagctgggcattgccacgctgatcggcatgatcatcggtcttgaacgcgagctgaaaaacaaaccgctcggactgaaaacctgtatcgtcatcgccgtcagctcctgtatgctgacgatcgtcagcattaatgcggcatatcatttcccaaaatattaccgaatcatgatggatccgctccgccttcccgcccaaatcatttccggcgtcggttttattggcgcgggtgtgatcctgcgtaaaagcaatgacgtcatatccggcctgacgacatcggccatcatctggggcgcagccgggctcggtctggctacaggcgccggcttttataaagaggcgttcgcaagcctcttgtttatcctgatcagcgtcgaatttcttccgtggctgatcagaaaaatcggtcccaaccgcttgaaggaaaaagatatccgcgtgagaatgtctctttccgataaagacaaaatgaccgagattttaaaggaaatgaaaagcaaacagctccgcattcactccgtccggattgatgatctgggcgaaaaagaatttccgattatggaagtgaaagtcagtgttcataaaaaccgctacaccactgacgtctattatgatattaaagaaattcaaggtgtcgtcggagtgaagtgtgatacgctataaaaaaacgccgggctggattcagccggcgtttttctatttatacgaatgcagaaaagttatactccgtaatcggggtttcattttcgatatcgcgcctgaaggttttcagcatctcaagttcctcgtccccgagtgaattgaggtcaaacgcctgatgcaataatccgtagatcagcatatgacgcagccggaggaaatccgggatgtgttcaagccaggcgggatcaaggtcattttcttccctgtagcctttcataaagtgagtcatgaattcacccgtaaacgcggccttgtcttcatacgggatgaccggataccacaacatgttgtacagcagaatactgatatcattcacaaaccaattgtagccgatatcatcaaaatcaaatgcagtgatttttccgttgtcccaattgaaattgccgtggtgcagatcggcgtgcacaaggccgtagttttcagggttcttcggcaaacggcgcagtttttccattagagcatccgcccgctcaaatacgagatgctgatctgcgggcacgtattttctcagcttcagctgctcctcttcatcccattcctgccttttatatgtcggatcgctcagacggtagcttttcgtcagccggtgcatgttccccgtgtactttccaagctcgtaaaacagagttccgttccagtctgattcctccactttgcgtccgggcgctttttcatagactcttactaaaaacgctccgccttttccatccggcacttcttcgacatctttgccatttaatgaaggaatcggctttgctgctgaaagccctccctttgccagatgatgaagccattccatttctccgagaatatattccggtgttcttctgatcgtatgcgtaatttttaaaatataaggttcgttatctttcacaatttcatatacgtagttctctgcgtccgcgataaattgaaacttggtaaagccgtatatttcacctgcttcagcgagcaccttatcttcctcaaaaatcgctttaatatctttatgcatgctgattcacccttttcataacgtttgtaggcggtgtgtgtactcagcaaatgtcattcatcaacattcctgcccttcttttttcacagcagattagtaacatccgcttagaaatgaaatgtgttttcctgttaattcctgattatacaaatatcttaacatacctcattcctcgctccaacgatattcacattaaaaaaacccttgctcatacagaaatgaacaagggcatcttggttaatcgtaaatatggacggtcggttctttgtcacccgcattgcggacgatcagcgcttcctgcccatcagacgaggtaatgttaatttcgacatcaactgagccttttgaataataatccatcagctcacctgttaagtattgggtgaaggcgatgacttcgcttttcccgtaaaattgcatcgggatttcaatcttcatttttctcatttcatcgttttcgtacattgccgttccgacgactccggtgtaattcgggaagtagctgtcgatggcgtttttgaagcgtttaaatacttcggaatcatcagggtatttctttgccgtgtctgtatccgccggatagaagacgtacttttctttgacatcatcccagtttgaaatggtggatgagccggctttgacttctgtttttgcaatgtaattccccggtacgattgatgttttcggcgcttgtttataaagggcgacggtaatcggcacatttttcaggttatccattttccgaaggcggttaacgacttcctgagcgatttcttcaccgtggctgcggatcgttttgtcactgagctccacttcctgctgcggatcacctgtgttttcacggtaatagtatacagagttgagagcgagaccgatcatgataccgccaagctggatggaatttttatcttttcttactaagtaatcctgctcaagcatggacgctaagtaaatcgggctgttttcatttttctcttttgccgatcccgagcttggcagcacgggatttaagccgagattctgaaaattggaatctgcctttttcgcctttttcagatcactgccttcttttttgcggtcaagccagctgagtaccgtgtcctcatctaaatactggccttcctgatacaaatagtcatccgtcgggaacgtgtcttgagcgagccgcatcagacccgtctcgaattcatcgatgtccagcctcgtgttcagccggtccgcagtcaggccgcgcgcttttccggccttaaacggaagcaccattttatagtaggaatcagagatattatatttcggtatgatcgctttttcagaagactttgccgttttctgcgtgatctcttcctctttgttccccccgaaactcggcgaacaggccgacagcatgagtactgccgccgttgccgtcgccgccaatgccaacatctttttcaatagaaaacactcctcttatttctttagctctcccaatagctgtgcttcattccatacttcaatatttaattcctgcgcttttgtcagcttgcttccggccgcttctccggcaatcagcaagtctgtttttttgctgacagatcccgtcagctttccgccgagcgcttcaatctgcgccttggcttcatttctggacagctcttcaagctttccggtcaacacgatggttttgccggcaaaataagagtcgctgtcctccgcttttacttttttcgggcctttgtagagtgtgttcacaccgagttcctcaagttcattcaatagctcaagcatttcttctttgcggaaataggtgataacggcatcggccatcttttcgccgatttcatccaccgcaagcagctcttcttccgtggcttgtttcagattttccaggctttcaaaatgcatggcgagtgttttggccgcttttgagccgataaaacggatgccgagaccgaacagcaggcgttccagcgaattctctttcgacttttggatggagctgatcagattgtcagttgatttttcccccatccgctcaagccggatgacctgctctttcgtcagcttatacaaatcagcgacattacggacgagatgttcacggaaaagctgtgtgatgacacgttctccgagtccgtcaatattcatcgcgttgcgtgagacaaagtgaatcaggccttctctgatctgcgccggacattccggattgatgcagcgcagcgcgacttctccttcaatgcggacaagttcgctttcgcactcagggcagctggtcggcatattgaattctttttcttccccggtccgctgttcgattaagacattgacgacctcagggatgatgtcgcccgcttttttgacgaccactttatcgagaatgcggatatccttctctttaattaaatcttcgttgtgaagggatgctcttgagaccgtcgttcccgcgacttttaccggttccagaacggcggtcggcgtaatgacgcccgttcttccgacattcagttcgatatcgagcagttttgtcacgacctcttccgccgggaatttataagcaatcgcccagcgcgggctttttgccgtatacccgagctcttcctgctggtcgagcgaatcgactttgatgacgattccgtcaatttcatacgggagatcggcccgcttcgcctgcagctcttcgatcatttcaatgacttcatctatcgtggcgcattttttccgttcctggtttgttttaaaaccgagctcatccagaaaatccaggccctgactctgtgtttccacacccatttcgtcaagctccgctatactgtagacgaagatgtcaagatttcgtttcgctgcaattttcggatcgagctgtctgagtgagcccgcagccgcgttccggggattggcgaacggctcctcttcatgtttcagcctttcttcattgagcgcttcaaatgactgtttcggcatgtacgcctctccgcgcacttctatggaaagattccgtttcattttcagcggaatgttgcggatcgtttttaagttttccgtgatatcttcgcccgtcgttccgtctcctcttgtcgcgcctctgacgaaatagccgtcttcataacggagagaaacagcaagaccgtctattttcagctccacattataagcaacgccgtcaccgacagcctgacggacccggcggtcaaaatcgcgcagatcatcatcgttaaatgcgttgccgagactgagcatcggcgtgccgtgctgcaccttttgaaacgattcaagcaccgctcccccgacccgctgtgtgggcgaatcaggcgttctgagttccgggtgctcttcctctatggcaatcagctcctgaatcagtctgtcgtactcggaatccggcacgctcggttcatctaaggtgtaatattcataactgtactgatcgatggtgcggcgcaattcttctgcccggtgtttcgctgtttctttgtccatcatgttcttcctttcctcttcaggttactgcttttcaatcggcgcaaaagcggcaagcagacgcttcacgccgactgggctcgggaatgcgatatcaagctcggtgctttcgccttctccttttacgctgacaaccgttccggtgccccattttttatggcccgctttatcgccgaccgcccagctgagcgagtcgccgcctgttttgttcgcataggaaacgggacgggatacgggcccgcgtttttgctgcacttttcttcccggctgcatgcgaggtgttttcttctcatttaggttctccaataaatcgccaggtatttccctgataaagcgggattccggattcatattggtgcggccgaataaggtgcgcattttggcattcgttaaatacagttcttcttccgccctcgtaatgcctacatatgcgagcctgcgttcttcttccatctcggcttcttccatcagggagcggctgtgcgggaacacgccttcttccatgcccattaagaacacgacaggaaattcaagccccttagcggcgtgcagtgtcattaaagtgacggcatcctttccgcctgattcctcttccttctggtcgagctggtcaatatccgcaatcagcgccaaatcagtcagaaacgcaacgagagacttgtcttcgcttttttgttcgaagtttttcgtcacggaaagaaactcgtcgatattttcaaggcggctttgggcttcgattgatttttcggccttcagcatttctctgtattccgttttctcgagaatttcttccgtgagttccgtaatggacaggtaatcctgcatgttcgtcagattttcaatcatcgcgccaaagccgtcaagcgcgtttgccgctttcgcgctgacgccgatgaaatcaacctgtttgatcgcctggaacattgacattccgttcatcgccgcatatgaagcgattttttctagcgaagtggcgccgacgccccgcttcggcacattgacgatccgcgtaaaactgatgtcgtcgtccgggtttgacacaaggcgcaggtatgcgagaatgtctttaatttctttcctgtcgtagaacttggttccgccgacgatattgtagttcagtccggattttaaaagggtttcctcaatgacgcgcgactgggcgtttgtccggtataaaatcgcgatatcggaaagcttccgccgccccgagctgtgcagctcataaattttccccgcgacgaattggccttcgccgaattcattgtcgccgctgtaataagaaagcttgatgccttcgtcattttccgtccacaggtttttcggcttgcggtttgagttgtttttgatcacttcgttagccgcctgcagaatccgctttgttgagcggtagttttgctcgagcaaaatcacgtttgcgctcggataatctttttcaaaggaaaggatattcgcgatatccgccccgcgccatctgtaaatggactggtcggagtcaccgacgacgcagatattttcaagacgggccgcaagctgcttcacaagcaggtattgtgccctgttcgtatcctgatactcgtctacgtgaatgtactggaatttgcgctgataaaactcaagcacttccggcacacgctcgaaaagcttaatcgtcgtcatgattaaatcatcaaaatcaagcgattggtttttcagcagttttttctgataatcggtatacacgtcactcgtgacctgatcgtagtagccgccggccgattttgcgaattcctcaggttcgatcagctcgttttttgcgctgctgatggaccctaaaatacttctcggatcaaactttttcggatcgatattccgctctttcagaatccctttaataacggaaagctgatcagccgtatcaagaatggagaaatttcggttgatgccgattctgtcaatatccctgcgcagaatccgcacgcacatgctgtggaaagtggaaatccagatttcatccgcgccgggtccgagaatgctctctaccctctccttcatttctctggcggctttatttgtaaatgtaatcgccagaatgttccatggcgccacgtgtttttccgccattaagtatgcgattctgtgcgtcagcacacgtgtttttccgcttcccgcgcccgccatcagaagcagcggaccgtccgtcgtcttgaccgcttcctgctgaacgggatttaatccgcttaataattgattgctaatgtaattcatatccgttcaccgcctatcaaacatatgttctatcataaatcaatttcgtccgcttggctactttgtctttacagccgccaccgttttaagcgcctgatcaaaatcttcatatacggcatttccgacaacgatgacatcggcatgacggccgaaccgttccgccgtttccgcgtctttaatgccgcctccgtaaaacaggacggacttgtccagcacagccttcgttttctccaccgtttctatgtccgccagcatcccgctgtattccagataaaaaatcgggagatgaagcaaatgctccgcgacccgcgcataggcgagaatatcttctgtttctatatgtgtatccgcctccgtcaaagcggccgccttacaatcagggttgacgatgcagtagccctccgtcacgatttcctccactgacatgagctctccgtattctttcatcgcctgatgatgcatgccgacaatccagtccgcctttttgctgttgagcacactcggaatgaaataaagatcaaacccgggcacaatggaatcaatcgtcgacacctcaagtacgcacggcactaaaaaccgccgcacctttgacatcagtctcagcacattgtcctcggtgatattgtcgcttcctccgatcacaatggcgtcagtccctgattcacaaagccgttccagttgttcatccggtaaatctttattcggatcgagtttaaaaacatgcttccactcgttaacatcgtacatgcgttttcgttcctccattcgtttcttgccatttaaacattataacaaattcgtttggcccggaaaaacggaaaaagacgtcattcacctgattcacaaaaaaagattgcgctccgccggacgggaaacggctatgtttgaaaacagacaatatgtggaatgtcaaagagaaaaaagacaaggagtctgatctcaatggaacaagccattatcgtactgatttgtatattgatttttattattttagttcccgccgcattgtttctctggatatacataagagacgaaaagcaggaagaacattcagtgctgcgcaattatcccgcagcgggaaaactgcgctatatatttgaaaaaatcggacctgagctgcggcagtatttattcagcaatgataacgaagaacagccgttttcccggagagaatatgaacagacggtcatgtccggaaagtataagagcagaatgatgggcttcggctcagaacgggatttcgatcagccgggctattatatccgtaacgccctcttcccgaaacaaagggaggagctgcgcgcagatcagacgccgaagatcgacacgatggtatacaagattgacaaagacaacctgctgaaacgcagcgaacaccgcgaaaaagcaaaagcggacccttattacctgcatccggacgatgtgcaagtgatcggccgcgacacatgcaagaagccgttttatgtgaaagggttaatcggacaatcagcgatgagctacggctcacttggcgacagggcaatcaccgccctgtcaaaagggctgcaccaggccggcggcacatggatgaatacaggcgaaggcggcctgtctgagtatcacctgaaaggcggcgcggatattatctgccaaatcggccccgggctgttcggcgtccgcaccgaagatggagaattttcgtgggaagaattcaagaaaaaaagccgcctcgagcagattaaagcctttgaattaaagcttgcacaaggggcgaaagcaagaggcgggcatattgacggttcaaaggtaaccgaagaaattgccgccatcagaaatgtgcagcccggacaatccattgacagcccaaaccgcttcaacgagttctcaaatgttccggacatgcttgatttcattgagaaattaaggactgtcggtgaaaaaccggtcggcatcaaaattgtcccgggcagccgcaaagaccttgaagaccttatttcctgtatgagttcatcaggcaaacttcccgactttattacgattgacggaagtgaagggggaacgggagcttctttccatgagctggcggattccgtcggcctgccgattctgaccggcctcccccttgttgacggccttttgaagacatacgggataagaaataagctgaaaattttcgcatccggaaagctgctcactccggataagattgccgttgccctcgcgttaggcgcggattttgtcaatattgcccggggaatgatgttttcagtcggctgtatccgcgctcaagtatgccacaccaatcattgtcctgtcggagtggcgacaaccgatccaaaacttcagcgcgcgctcagtatcgaggataaacagcaccgcgtctgcaactacgtgctctcgttgcgtgaagggctgtttcacctcgccgcggcggcgggcatcagctcaccgattcatttctcagctgaacacatcgtataccgggaggaagacggaagcctgagggaacttcccggccttttgaatcagcacgcataaaaaaaaccgcctgccgtcatcggcagagcggttttttacgtagctgaggaggattctcctttgtttacgcggtcaagcgccatttcataggcgtcgttaccgtaatttaagcatctcttcacccgggaaatcgtcgctgtggaagcacccgtttcgctttctattttgtgatacgtatttccttcgcggagcattctcgccacttccaaacgctgcgccagcgattggatttcattaatcgtacaaagatcgtcaaagaaacgatagcattcctccagatctttcagcgataaaatagataaaaataactggtccagttcttttccgcgtaatttatcgatttgcatcgtcaaacaccttctcctttactaatggaagctgcatcgagatcaggcacgatattaatccatgtctttcctggcacaaacggaagaatctcaccgccttttacgggcagaatacggccgtctttatattcccagtctgactccataacatcgccgtgctgaagcaggaggcccttcccccctgactgaatatcgatggcccgccttccatctttgtctgtcatgcgatggccggcttcaacaataaaaatgttgtgcatggctaaaggctttccggtctcccggtctgtcgctttcacaccatcagagcttcttgtataagcatcagcttttttatcataatcgtattcgacaagatttgtaatgttttgtgttccataatctatccgaatattgtaggtttcatttcctggttttgcatctgatgtctgaaatgggagcggttctgtttttccgttcagcttgtatcctttttgttccgccgccttcctgatattgtcatacgacgtgtaggaattgtggggcggcttgctgaaatcggctctccaaaacaggcttccgtcaaaatccaaaccgtttatataatcgtaagctccggactccagctgcttttttgcgccgggactccagccatgatggacaaatatgctgttaaacccgctgctgagcgtgacaaaatattccctcgcgctccgcacaggcccgaccgtttccggcatctcactttgaaaaatcgcgagaaaccgcgtaatccggccctccgcgagcgcttcgatgacaacatccgcctttgacagcccggattggggcctcgccttcggatgattgttcactgcgactgcaatcggacggcgttctgcaagcttctgctcagttttcagccccgttaaaggagcttccgcttctttcggctgcacctgatcggcattgttctgccggcaggcggcaagcagcaaaaacgcaaaacaaagcatacaaacggttttccatcttttcatatgtcggctccctgcttttatattttaacgcattatcgatggaaagagtacagtttttttcatcacgtcgaatattcctctcggcgtaatgcggatataaggcaggtgtgtgctctgcaaaaagagcagcgtatagatcggatcgcagaatcggtagccccgctcctccagcagcgtcctcagtttttgctctttctcaagcacttcttcatacttctccgcggatgcagaaccgtttaaggcgaggggaatctcatgaagaatcttcccgttttcggcaagcacgattccgccgccgatttctttcatccgtgagaaagcgagcaggatatcttctttattttttccggcagcgataatatctccggttgtcgtgtaggaactgacaaagccctgcacccgatcggcaaaacctttcagcattgtattgacccgccattttccatgcttatcgagaagcgtgagatagcattcatcatgatcaaaagaaagctggtcaacagaattatcaatcgcaatcatatacggctccataatgaccgcgttgcgcatcgtcacacccatcggcattgaaaactgtaaatcatccatcgtcatatcatatgaaagctcaagagggacgagaccgccctttttccaatccgtttctgtaaacgcattcatatttcggccgtcttctttcagcaggatgcctttggagatcaccgtgaccgggtcaggattcatcgggtcatcgagaatgttcaatgaagcaagccgtcccggaccgaccacaccgagatagtcgtccatctgataatacttcgcgatattaaaggaggccatattgtaggcatcgattgccggaactccttcctccaaagcgattttgattaattcattcgtcatgccgcctttataaaaatgcggcgtcgctccatccgtcgtgtagaagaaatgatcataatgccggaagcctttttgatggagatcctgcaaaatcgttctcaaatcagggcggatggatgaatgtctgagcgaaacatagtagcccaattcaagccgtctcatcacctcgccgccattcatcgcctcgtggtcggaatcagctccgaacagtttcatcttcgtcagtgttttttcagaggctccgggaaaatgcccttctatccgcttgcgcagtttctttgtcgcctgcatgcaatgaagcatcaggtcatcgccgtccatgaggcgcggccatccggtcaattctccgccttgaatgacatccgggtgctcaatccattgctttcgaacatcaaaagaaagaagctgatcctcattcagcacttcagtctgcagatcatatctggaccaccagaaatattgcaccggctgttttttcagttcttccaatatagtaagcgctttctttttaccgctgtgcaaaagaaaaaacaagttatcattaacaaacgtcgttgttccgaattgagacacatattcggcgagcgtttggggattatatatttgaaaaggatgtgtatgcggttcaatgtaacctggcacaatgtattttccttcacaatttatggtatgaatgtgctctgctgcatcaggaagctcatgaccaacatatacaattcgatctccgtaaatccagacattctttttcagccattgttttaaaaaaggatttaatacgagagcatcccgtaaaagtagcgttggaagcagctttgagtctacaacatccgcctgtgatctgatgtctttatttttccagttaaaggtgcgttcggacattcacatactctccttcgcttatattagacccatcgtatcacatccgcacaattatcgcacggctaaaacgttacaaattattgaagatgaatgaaaaactttttctaagggagctgaaatgatgaaaccgaatatcagtttattaaatgccgttatgcgcatcacttgcggcctcaccattttgtctgctgcttcagcgaaatacacgagaaaaccttggtgcaagatgcatctcttctgtatgatgatgggcgcgatgaaagcggcgtccggcatcctccgcttctgtccggcgacatatatgttccaaaccggaatgaatcaggatgacagccatcagcaagaaaaataacaagccgtttcggcttgttatttaatttctcctgtcccgcgagtctaagaagaatccgtctatacgccggaggacttcatcgatgcctgcgtgtcacacggcaagccgacagtcttagtcgtcttttcagaagaaaacccgcatcttatatgacgcggggttttcctctttatcgctgcgatgctttcagcgcacgggcgccgatatcgcttctgtaaaacagtccgggttttgtcagccctgaaacggcgctgtacactttatctctcgccgcttcaaatgtctcagcaaatgccgtgacattggcgacccggccgccgtttgtaacaaattgtccgccgtcttttttcgttccggcatgaaaaacggcgatcccgtcttcagcggacgtcaaactgccgatcggcgtccctttcgcatagccttccggatagccttcagaagccagcacaacgctgactgcggccgtatccttccaccttaggtcaacatccttctcatgcagaagatctaagagcacctgaatgaggtcggattccattctcggcacgacgacctgtgtttccggatctccgaagcgcgcgttgaattcaatgacttttgatccgttttccgtcagaatcagccccgcgtacagcacgcccgtgaaggagcgcccctcttttaccattgcttttgccgccggcttcacaatcgtttcgactgcgcttctgacgatatcatcggaaatgtgcggcactggtgagtaggctcccattccgcccgtattcggccctttgtctccatcgaaggcgcgtttatgatcttgagcgatgaccatcggatagacggtctccccttttacaaacgccattaaagaaaattcttcgccggcgaggaactcttcaatgacaacagatgcgctcgcctccccgaatttctcatcctcaagaaaatcgtgcaggcattcaatcgcttcttcttccgtcatcgcgaccgtgacaccttttccggcggcaagcccgtccgctttaatgacaatcggcgcgcctttttgctgcacatatgctttcgcctcttcaaatgaagtaaacgtctcatactccgccgtcggaatgccgtattttttcattaaatccttggcaaactgtttgctcccttcaatgattgccgctttttcagacggtccgaaaacaagcagtccggctttttcaaactcgtcggctatcccttcaatcagaggaacttcggggccgataatcgtcaggccgacatgatgttctttcgcaaacgcaatgagtgcggcatgatcgctttctttaatgttgaccagcgtcgcgcagtctgccataccgtcatttccgggcgcggtgtacaccgtgtcaacaagcgggctttgcgccgctttccaagccaatgtatgctctctgccgccttttccgataatcaatacattcacgcttcgttccccctcttaatgtttgaaatgtctgataccggtgaataccatggcgatgccgtattcatccgcttttttaatcgaatcttcatcgcggaccgatccgcctggctggataatcgccgtgacaccggcttttgcggcttcttcgactgtatccggcatcgggaaaaacgcgtctgatccgagcgcgctgccttttgctttttctccggcctgctcaatggcgattttagctgaaccgacgcgattcatctgccctgctcccacaccgaccgtcatatggtcttttgcaagaacgatcgcgttggatttcacgtgtttgacgactttccaggccaacttcaaatcttcccattcctgctcgctcggctctctttttgtcgggatgctgatgtcggcgtcatcaaatccatggacgtctaaatcttgaatcaaaaggccgccctgtacggatgtcagctgtttttctttcttccctgatgcggacacgtcaagcgtgagcagacgaaggtttttcttcgccgtcagtacgttcagcgcttcttcactgaaagaaggggcgataatgatttctaaaaagatgccgtgaagggcttcagccgttgcctgatcaacttcacggttcagcgcgatgatgccgccgaaaatggaggttttatcagcttcatacgctttattgaatgcttcctcaattgaagctcccgtaccgactccgcacgggttcatatgtttaacggcaacagctgcgggttctgtaaattcccggacgatttgaacggccgcatccgcgtccttaatattgttgtaagaaagctctttcccgtgaagctgttttgccgccgcgatggaaccggagacgggaagtgcgctttgatagaaaacagcctcttggtgagggttttcaccatagcggagcgattgttttttctcaaatgtaacggtgaattgctcagggtctttctcaccggcctcgcgtgttaagtaatcagcgattaatgcgtcgtatgccgcggtatggcggaatactttggccgcaagctcgcgttttcttttaagcgaaacaccgccgtgttctttaatctcattgagcacggagctgtaatcggccggatctgtgatgaccgtcacatcctgatggtttttcgatgcggcgcgcagcatgccgggaccgccgatatcaatgttttctatcgcttcatcgtatgttacgtcttctttcgaaatcgtttctttaaacgggtaaaggttgacgaccacaaggtcaatgggggcaatgccatgctcattgatctgcgccatatgctcttcattgtctcttacggcaagcagtccgccgtgaatattaggatggagcgtttttaaccgtccgtccataatttcaggaaatccggtcacttctgaaatgccgatgacatccacaccgttttcctgaagaagtttttttgttcctccggtcgaaatgacttcgacgccgagctctgtcagttcctttacgaaaggtacgagatttgttttatcagaaacactgattagtgcgcgtttgattgtcatgccttttcacctctgttatttagtcccagcagctgtttcacaacgctcggataccatttgtgctcaagctcgtgtattgtatgctctatgttttcaagcgtatcgttttcctgtatttcgaatgctttttgcgcgataatcggtccggtgtccatgccttcgtcgacgtaatgaacggtaatgcccgccactttcacaccggcccgatacgcctgtccgacagcgtcaatcccggggaatgccggaagaagcgagggatgtatattaataatgcggcccccgtatgcttcaagcagcgtatctccaatcagtctcatatagccggcgagaacgattaattccgccccgtgcaggcgcagctgttcaataacggcccgttcaaaggccgctttgttttcaaaagatgacggttcaaaggcgaatgacggaatgtgtaaagcctccgccctttccaccgcctttgcctgaggcttatccgtcacgagaagcgagagctccgcatcccacttctcttctctcatgcgtttggcaatggcctcgaagttcgatccgtttcctgaagcaaataccgcaaactttttcatgaaagagccgcaccgccgaaagaaatgccttcgccccgcttgacccggccgatcaaataagccttctcgccctgagcttcaagcgtgtcgataacgtctgtcaagtcctcttctttaacggcaaggacaaaaccgatgcccatattaaagacattgaacatttcttcttctttcagcttgccgtgctcctgcagaaacggaaaaatcggcgggatcggccatgatccgtgatcaatttccgcgctcaatccgtccggcagcatccgcggaatgttctcgatgaatcctccgcctgtcacatgcgccatgccgtccaccttaccgcttttcaccgccttgagcaccggcttcacatatattctcgtcggttccagcaattcttctccgagaggacgcgcaaacggttcatagacagtatccaaatcaagtccgccgtcatcaagaagcacttttctcacaagggaaaacccgttgctgtgaaggccgcttgaagtaagtccgattaagagatgtccctcttcgatatgttcaccggtgacgatttcgtctttttccgcgacgccgactgaaaagcccgcaatatcgtattcatcagccgtatacagccccggcatttccgccgtctcaccgccgataagcgctgatcctgactgctcgcatccgtccgccacgccctgaacgatctgctcaatttttaccggatcggccttgccgaccgctaaataatcaaggaaaaacagcggctccgctccttgggcaagcacatcgtttacacacatcgcgaccgcatcgacgccgatcgtgtcatgcttatccattgaaaatgcgagtttcagcttggtgccgacaccgtctgttccggaaattaaaacaggcttttgatacggaagctctgacagatcaaacattccgccaaaaccgcccaggcttcccataacgccgagccttttcgtgcgctccacgtgttttttcattcgtttgacggcttcatacccggcttcgatgtcaactccggcatttttataagcatcagacatccctatcactccttatcaattcgtttctccttaaaaggcagaaagagaaaggcagcctgaattcccgctgcctttatgtcattttcagattttattttgtcagcaccgcttcttttacgtgaggaagcactgtatcctgataaatttccgtcggatatttgcccgtaaaacaagcgaggcattgtccgcaattggtgtcttcaaattttcggccgactccttttaacaatccgtctacacttaagaaagaaagcgtgtcagcaccgatgatctggcggatttcttccacggaatgagaagaagcgatcagctcctcatgggttgatgtgtcgatgccgtagaagcacggatgagcgatcggcggtgaactaattttcacatgcacctctgtcgcacccgcttctctgagcatcgtgacaatccggcggcttgtcgtcccgcgcacgatggaatcatcaaccatgacgacccgttttccttcgacaacaccgcggacggcggacagcttcattctgacgccttgctcacggagagcctgtgacggctggataaacgttctgccgacataacggtttttaatgagaccgagttcgtacgggatgcccgttgcctcggcatagccgatggccgcagaaatactggaatcaggcacgcctgtgacgacatccgcttcaaccgcggactcctgggcaagcatttttccgaggtttttccgggcgctgtgcacgttaatgccgtcaatattgctgtcaggccttgagaaataaatgtactccatgctgcagatggaacggttgatattcatggagaaacgctctgatttcatgccttcatcattgatgatcagcatttcgcccggctctacctcgcgaaggtatgtcgcgccgaccacatcgaatgcgcatgtttctgatgcgacgacgtaagcatcgcccatcatgccgattgacagcggtctgagtccgttcgggtcaagcgctacgatcatttctgtttcagtcatgattaaaaaggcataagcgcctttcagcatagatagcgaatttttgatctgatccttcagcgaaaagtgtccgctgcgtttaatcaggtgagccagcacttccgtatcggaggaagtctgaaagatgctcccttggttttcaagctgctgcttcaactgtgtggcgttgaccaagttgccgttatgggcgagcgcgaggctgccgttgttttgcgaacggaataggagcggctggacattttcatatccgcctccgcctgccgtcgcataacggacgtgcccgatcgcgccttttcccttcactttgctcagttcgccgttttgaaaaacctcggtaataagcccctgtcctttatgcgccgtcagtttttcaccgtcagttgcgacaattcccgcgccttcctgtcctctgtgctggaggctgtgcaggccgtaatatgtgatctgcggagcttcttcatgtccccagatgccaaacacaccgcattcttcattcaggcctttgatttcagcaagcatggaatagctcctttccacgcgcgctcaagttctttcgtttgcgcgtgaaccaattgttgtccgtcctggttttgaatcgccagaagtccgtcagccgttacctcaccgatatgaaccgcatcggccacagccgcttcaaacgcctcatggtgttcttttttcactgaaacgacgaagcgggattgagattcagagaataataatgccgcttccccttctacagtcacgttggcgccaaggttttccgtcgtcatgacgctttctgcaatcgctacgcctaagccgccttcagacacatcatgcgctgattgaacaaagccttttttaatcgcgtcaagcaatgctttttggcgtgacagctctatatcaagatcgatttgcggcgctttgccgtaaatgcgcccttctgtcattttttgcagttcgcttccggcaaactcaggttttgtttcgccgatcacgtatacaagatcccccgcttgtttgaaatgctgtgtcgtaatatgagcggtatcttcaattaagccgaccatgccgataacaggcgtcgggtagatcgccgttccgttcgattcattataaagtgatacgttaccgccgatgacgggagtgctgagaacattgcacgcctcgctgatgccgtcggccgctttttcgatctgccagaaaatttcaggtttttccgggtttccgaaattcagattatccgtgaccgcaagcggttcggcgcctgagcatacgatgttgcgcgccgcttcggcaacggcgattttcccgccttcttcaggatcaagatataaataacgggcgttgcaatccgtcgtcatcgccagcgcttttttcgtgccgcggattctgagcactcccgcgtcagagcccggagcgaccaccgtatttgtgcgcaccatgtagtcatattgatcgtacacccactctttgctggcaattgtcggctgctgcagcaaggcaaaaagcgtctctgtcccatcttttacttcaggcgcgggaacttctgtttcctgaaactcgcggtagtacgcgggttctgctgacggcttgtggtatacaggcgcttcttccgccagcgcgtcaaccggaagctcgcaaacaacctctccgttatggcggaggcggagcattttatcatccgtaacatgacctacggaaaccgcttcaagatcatatttatcaaaaatatcgacaatttcctgttcacgtccgcgttcaatgacgagaagcatgcgttcctgagactcggaaagcatcatttcgtaagcggtcataccagtttcccgctgcggaatgagatcaaggttcatttcaatgcctgagccggctttgcttgccatttcagcactcgaacttgtcagaccggccgcccccatatcctgaatgccgactaaggcgtcgcattggatgacttctaggcatgcttccaggagaagtttttccatgaaaggatcgccgacctgcaccgcggaacgtttttcttcagatgaatctgacatttcttccgatgcgaaagtagcgccgtgtatgccgtcgcggcccgttttagcgccgacgtacatgaccgtgttgccgacacctttcgcctggccttttttaatatctttatgatcaattaagccgacgcacattgcattgacaagcggatttccctcatagcttgcgtcaaactgcacttctccgccgaccgtcggaattccgatacagtttccgtatcccgcgattcccgccactacttcttcaaacaagtacttcacacgaggtgaagtgagctcaccaaatcgaagagagtttaatacagctatcggacgggcgcccattgagaaaacgtcacggatgatgccgcccactcccgtcgcggcaccttggtatggctcaatcgctgacggatggttatgagattcaattttgaacacgaccgcctgattgtcaccgatgtcaacgattcccgcgccttcaccgggaccctgcagcacgcgttcgccgctagtcgggaatttgcgtaaaaccggttttgagtttttatagctgcagtgctctgaccacatgacggaaaaaatcccgatttccgtgtagttcggcaatcttccgataatagattcaatgagtgcgaactcgtcatcactgacacccatttgctgatagagtttctcttcttttatttgttctttacttggttcaagcagtagcgacatgagtttccctccaatttttcacgatagaccggaacaatgtaagaccgtctgcgctgccgagcagttcatcgactgcgcgctcagggtgaggcatcatgcctaatacgttgcctttctcattcacgacgccggcaatgccgctgacgcttccgttaatatcgccgccgtatgtgaaggcgatttgattgttttcttttaatctttcaagcgtttcgtcatcacagtagaaattgccttcgccgtgggcaaccggaatcgtaatcgattgtcctttttcataggaagatgtgaataacgtaccgccgttctgcacgattaattcaaccggtcggcagatgaactttaaatctttgttgcgtctcatcgcgccgggcagaagtccgagctcctgcagaatctggaatccgttgcagacgccgagaaccggttttccttcggcagccgcttttttcacagccggcatgatgtttgcgaatctggcgatggcgccgcatctcaagtagtcgccgtatgaaaacccgccggggatgagcacgccgtcaaatccgtcaaggcttgtttcctcgtgccagacatactcgacttcttcgccgagttcgtcctttacggcgtggaacatatcaatatcacagttggagccgggtaacacaatcaccgcaaatttcactgtgcgacaacctcctcaacttcatatcggtagtcttcaatgactgtattggcaaggagcttttcacacatttctttcacgagcgcgtcaagatcgcggtcagatttttcaatcgtcagctccatatattttccgatgcgcacatcctgcacttcattgtaggtcatgctgtgcaatgcatgctgcaccgcgcttccttgaggatcgagcacactttcttttaagctgacataaactttcactttatacattatgaaatgcctcccagtcttttgaaaatctcttcatatgcgtcggttaagcttcccaggttccgtctgaacaaatctttatcgagcttttcgtttgtgtctttgtcccacagacggcacgtgtcaggagaaatttcatccgctaaaagaacccgtccctctgcgtctaagccgaattccagcttaaaatctattaatctgacgccgcagtcttcaaaaatatgctgcagctcttgattcacctgttttgtaatcgatttgatcgtttccacctgctcaggagccgccgcttttaaaagccagatatgatcttctgtgatgagcggatcgccgagtgcgtcatctttatagtaaaattcgataatcggctgcggaagctctgttccttccgggatgccgaggcgtttcgacatgcttccggcggcaacgtttctgaccacgacttcaaggggaatgatgctcacttttttgataagctgctctgattctgaaacacgctccacaaagtggttgtcaattcctttggcgtgcagatgtttgaaaatcaggcttgaaatttcattgttcagacggccctttccgctgatctccgcttttttctcaccgttaaaggctgttgcggaatccttgtagaccacgcggagaatctgttcgtcttcagtttgataaatccgtttcgcttttccttcataaagaagattattgttcacaatattcacggaaggcctcctaacccgaatgttgggaatattcaatctatggcggctgaagaagccgcctccggctggcttcttctataaacctaaacgctcaaagatcaagtcgacgtttttcaaatgataattgtagtcaaagcaatcggcaatctgttccggtgtgagacgggacgtgattttttcctccgcttcgacaagctggcggaacggcacttgtttttcccacgcttccatcgctttcggctgaaccgtgtcatatgcttcttcacgaggcagacccgtgtcgattaaagcgagcagcacgcgctgagagtagattaaaccgagtgtgcggtccatgttgcgtttcatattttccgggaataccgttaagtttttgacgatattgctgaatcggttcagcatgtaattcagcgcgattgtcgcgtcaggaagaatgatgcgctcagctgatgaatgagaaatatcacgctcatgccataacggtacattttcgtatgccgtcagcatgtacccgcggatcacgcgcgccatgcccgtcatattttccgacccgatcggattccgtttatgaggcatagccgatgaacctttttgtccttttgcaaaaaactcttccacttcacgagtttcactcttttgcagaccgcggatttccactgcgaatttttcaatgctcgtcgcgatcaaagccagtgccgccatgtaatccgcatgacggtcgcgctgtaatgtctgagtcgaaatcggcgccgctttcaggccgagtttttcacagacatactgttctacgaacggatcaatatttgcatatgtgccgaccgcgccggaaagcttcccgacttcgatcccttcttttgcctgcttgaaacgttcaaggttgcgtttcatttcttcgtgccaaagcgcgagtttcaggccgaatgtcgtcggttccgcgtgtacgccgtgcgtgcggcccatcatgaccgtgtatttatgttctttcgctttttcttttataatgtcaacaaatctctcaatgtccttgagcaagatctcattcgcctgttttaatagataggaaagagcggtatccacgacatctgttgacgtcaggccgtagtgaacccattttctttcttcgcctaatgattctgaaaccgcgcgggtgaatgcaacgacgtcatggcgcgtatcctgctcgatttccaaaatgcggttgatgtcgaaagacgcgttttcgcgcatgactttgacgtcttctttcggaatgacgccaagctcagcccaggcttcacaggctaaaatctcgacttccagccatgcctggtatctgttttcgtccgtccagatcgcggacatttcaggtcttgaataacgttcgatcattatgctcgtcctccgtctcttttcatccatatgttcgtgatgtcctgaatccatgtttcatcaggcttccgtaaaaatgtcatatgccccattttgcggccttttttaatctcatgttttccgtacaggtacagtttggcttcctttaaaagctccatatgctcctccgcaagcttcacttcatcaccgagcagattcaccatcattcccggtttgagaagatcggttctgccgagaggaagtccgcagaccgctctgatgtgctgttcgaattggctcgtttcacaaaggtcgagcgtataatgcccggagttgtgaggacgcggcgccagttcattaatcaaaaggtctccgtcttccgtgacgaacatttccaccgcaagcggcccgacaagttccaatttctccgcgagctgaacggcaagcgcctctgcccgcttttgaaccgtttcctccgctctcgcgggtacgatgctttggaacagaatattatttttgtggatattttcagcagccggaaaggttgaaatctcaccgtgcaccgatctcgtcacgataacggaaagctccatccggaacgatacccagctttcaagtatgcacgtgccgttttctaacagcacagccgcttcatctgtctgtccttcttccttaatgacaaattggcctttgccgtcatatccgccgcggcatgttttcagcaccgccgggagccccagtgcctgaacggcttcctcaagctcccgtccgctgtttacgatccgataaggcgcgacttgacagcctgctgactggatcgcctttttttccgtttccctgttttgggtgatgagcagcagctcgcttccctggggaagatatgcatgttctttgagccagttgagcgcctcgtaatcgatattttcaaattcataggtaatgatgtcactgactccggccaatttttgaatcgcttcacggtcattgtactgggcggtaatctcaatatcggcgatctgtccgcaaggcgagtctttcacgggatcgacgacagcgactttatagcccatttgttttgcggcgacagccatcatttttccgagctgtccgcctccgataatgccgatgacggcgccggggtaaatcgtttttttatcagacaagctgatcactgctttccagcaccgtttgttttgtcgcatttcttctcgcctctagtttatccgcaatgtcatcgtcaaatgccgacaaaatttgcgcggctaacagacccgcgttcactgcgcccgctttcccgatcgccgtcgtcgcgaccggcacgccgccgggcatctgtacgatagacagaagagaatcaagcccgttaagcgattttgtctgaaccggtacgccgatcaccggcagcgtcgttttggccgccgtcattcccggcagatgcgccgctcctccggctccggcaataatgacttttaagcccctgtctctggcgctttctgcatattcaaacatcaaatcaggcgtccggtgcgcggataccacctgtttttcataaggaatgtgaagttcgtcaagtatgtcgcatgcatgtttcattgtctcccaatcggaagtgcttcccatgatgattcctgctagcggctgcattctgttcccaccttctcatgctttgtttttcagaaaaaaaagcccggcttatattgcaactatgaggaagcaatacaaaccgggcatggcgcgcgtatcgtcagtcgttcgcttctgcgatatccatgtcagctgtttatcactttcctgcatagtccggccgtttacggcagccgggtagaaacttatgggccatattcccaagattatatgaggtcgtgttttgatttcatgtttatcttaacaacggacttggataatgtcaacgacattatcgaacgatataaaaattctttcttttaatgttcgtgtttagatcaatttcccttcaaatacgatttttttcccgcaaggaacgacttgaattgatccattttctttcttttctgtaaagatcggctcttccatccgccggacgggcatataaccctcttccttcattaaagtgagaatggtgtcaatcgtttcatcttccgttacttcaaaccgtttcttttttggctttgtcattccttaattctcctcttcttcactgctttcacccagaatccgccgtggatcgttttcggctcaaaggcgatgataaacgctttttcatcaagcgttttaatcgtatcataaagctgaagctcatatttgcgcggcgtcagaatctgcatggcggtccggtctccttcaagtccgcccgcaacccagcttgtaaccccgtatcctttttcccggagctgtttcggcaggtccagatcgagctccttcgtaatgacgttgactgtaatatagccgagcgccagtttttcctcaattttcattcccactataacaccgatgccgtagccgagcgcataggcaatgacgttttgaatttgattcagattgccgagcacaagactcaggccggtcacatacacaaggatttcaatcgtactgatgcctgcggcgaaatagcgctgtccctttaatgtcagaatcatcctgatcgtaaagaaagagacatatataatgttaatgatgagaataatgagaaccatacctatactgttggataaaatcgtctgcatcactgattcccctcctctgatactttgaaaagcatcaatccttcaattaaggatagtttaccctcttttcatcattttcaaaagaaaaaaaagcccgccccgcaaggcagactttcaagctcttatcagtgaagctcggcttttttcaatcgtttgacggcttcatattccttctcaagttcactcagcgtgtacccggacagttcctgaacatggtcttgataaaaccctgagcggatcagttttgtcctcaggtgctgttttttccgattaatggcttctcgcaacaacggggccatcttcatcatccctttccgaatcataaagagtagtgccgctttcgaattgctgttgctctcatcatatctcggccgggtcctcaaaacaacacgctttattagaaaaatttgtaaacattgtgaaagacaaatttcgacttataaagggatcagcgaagcagtaaagtactctgaaataagcggccatgtcacagccgtaaaaatgagcatgatgataaccgccgcggaaatacagtacatcacgtcagccgcaggcttttcagccgatttgtatagaatctgcacaaactgcaccatcgccgaggcggccagaaacaaggtcagcgccgtaaacaccacggtgatgaccggcagattcaataccgcgaaaatcatccacacgatagagctggcgacagccggaaccaaaagcgatccgacccccgcggccgcatcccgcatcgtgattttctgtttcatcatatagcgagatacaagccagaccgcgcccgccgcagcggcaaaaaagacgagcgtatacacgagaacgacggtaaagccgtcaaaaaacgtatgatgccgctccccgtatccgagaggcctttgctggcttgccctcagctgaaaccaatttccgattgagaaaaagatactgaatacaagcattgaaataagagcatatttaaagcgggaaaagccgtcttccccaacgaccttcaccggtgatgtcaaaatgcgcagcgcgaaacggcaataacgtttgaccgcggcccatgcagaagcgagtttttccgtaaaagccggagccgggcgccgttccttttcttttttcttttgcttttgataacgtcccgcatttctggacattctcgacagcggttcttcatcagttccctgatgctgtttttcttcttccaacgtttcttttctttcttccgtcatgtcagcaactcctatcaaaaaaatacggcggaatttgttaaacaagaaaataaaacacttatataaggtaccgaagcgtcctcaaacagtcaagcggttttcttcacccggacacccacatgacgttttatagtatgtattggttttacggaataggacaaaaacaaaaaaccggcttaactcagccggtttttccgttatttcaagaagatgaaatacaggataaagatgacgaacagtccgtacataatcgggtgaacgctttttccttttcctttgcagatcattgtaatcgggtagaatataaaaccgatcgcaatccccgtcgcaatgctgtacgtcagcggcatcataatcatcgttaagaatgccggcacagccacctcgaatttatcccaggcgatcttaccgagcggcgccaccatcagcgcgccgacaataattaaagctggagccgtcacattcgtggtgacaactgacagaagcggcgagaaaaacatcgccagcaaaaagagaatgcccgtcacaacagccgcgaagccggagcgcgcccccgccgcaacgcctgagctggattcaacataagaagtcgttgtagacgtaccgagtacggctccgataacgattgatgttgaatccgccagaagcgctcttcccgcacgcggaagtttgttttccttcatcagcccggcctgtgtcgctacagccaccagcgttccggccgtatcgaaaaacccgacgaacaagaaagttaaaatgacaatcagcatttggacggagaagatatccggaagatgcatccacgcctgtccgaaagtcggcgcaagactcggcacgctgccgacaatgtgcgtcggaaccggaatcagtccgcagaccatgccggcaaccgccgtcagaagcattccgataaatacgccgccgtttacgcgaagcaccatcagaatgaccgtcacaataacaccgaaaaccgtcagcagtacaggaccgctgtgaatattgccgatagacaccaaagtcgatgagtttgcttcaataatgcccgaaccctgcaaaccgacaaatgtgataaacaaaccgatacccgcgccgaccgctaatttcagctcaggcggaatcgcattaatgattttttcccgcaatcccgtcagcgaaagcgccacgaagataattccggaaatcaagacgccggaaagcgcagcctgccatgaaatccccatgccgaggacgacagagaaagcaaaaaacgcatttaatcccatacccggcgcaatcgcgatcggatactttgcaatgagccccattaaaatacagccggccgcagacgccaaggctgtagcggtgaacaccgcgccctgatcaatttttaatgcttccggaaatcctttcacaccgtttaaagacaatgtcagcggattgacgaacagaatgtacgccattgacaaaaaggtcgttaaaccgccgatgatttcattacgatagcttgtccccagctcatcaaactgaaaaaattgcttcaagccaattgcctccttcattctctcccatttattctgcccgttatccgccaaataaaaaacgccccaaatacatttgggacgcttgactacatacgttcagtctgaataaataagaatggattatttatatcaaacgattgagattgatccgtagtcaagccatttacggtagcttggtagaaacttgcgggccatatccccgccattatacgatatctgcatatttgatttctgagtctattgtatcaattcaattttgaaaactcaataaaaaaaacgaacaatcccgttaaaaaaatttggtttattcgttaattgaccaaaaatggaagacggcaaaagccgccttcccgacatcattttccgtcggcaggcccgaccggcaccgcgaatgtgatcttgctgtcacctgctaaaatgttcatggccgtttgattgacgtacaaagcatatgaatcgaatgagaaatcgcgcaacgaatagtctttatcggatgaatcatccaattcaaaaacggattccatttcacccgttttaaggttcgtgactttcgccttattccctttcagataatagccttttttatactcattaagcgatggccaggttttcatttttttcgtattgccgagaccgatagactcaccgatattcatcagctgatcttcatccgccttgcttacatcaattccgctgaattgataatccacaattacccgtctgccttgctgtttgatctttttgacggtaatgccgacatgatgatgtttcgtttcataactgacgggcagttttgttttcagaggcacgatttctccaggctctgattctgtttttatatcgcccgttatgaaaagtgttttcgctttcgggtctatcggtttgctgaattgagtttggccgcgtattcttttcccgccgccgggaagattctttctgccgccaagttcaatattcgacgccgtcatttcataatggtttccggcatcatccgttgcctcgtcaatcgagatggcatcatttttggctgcatcagagaagtcgatagaatacaggagagccgatcccatcgttccgttttccgcccggatatcgaaaaagcggtataatccgtgatttacattcacagctttcgttccttcaagagaaacggacttttgttttttgatcggaagtgtaaagcgccagtttccggggatatccttgatttgtgtaatgacaagcggaagcttatcaccgtctttcagctttgagccgtccgtgaacaggcgaagctgccccgcgtaccgcccgtctttcatttttttcatatcactgctgtcataatcctctgctaacatattccgtggatctttataatcaacttgaaaagagatgctctcctcatctgatttcaaattgtcaacggtaaaattgtaaacgagctgtccgctgtcgtaatacacacttttcactgtcaccgtaatcccgcgtgattccgctttctcattcagttttgtcaccaaattgcttttaaacagcgcagaacctgccttatcctgaaacagactgtaaatttgtccggcaacaggaatgtttcccatagccgtgttaacggagggcatgaataagcctgaggacaaatacagaataaacaaagcagcagcaaccgcgagtccgtttatcacttttcgtccccatctccgtctgacggcgccttcttttccggcacggacaacagcgctggatatcacgtttttcaactcagctttcggcacgtcaatgtcctgatacaattgcttcatttgatgcttttccatatatgttcctccttttccagctcctgcttcaatgcttttctcgccctgtggagatgcgtttttacagtgccttccgccataccggtctgttcagcgatcatagcaatcgagaaatcttgaaaataataaagctgaatggtcagctgtatatgttcgtcaagcgtttccagggcattccgaagatctatgtattcttcaatgttcttattctccgcgcgtgtatcatgttgcggctcaaacgggatgacgtctccgtgctttttcctcatcgcaaaaatcgtatgaagcaaaatccggatcagccacgttttaaaatatttcggctccttcagctgcgcgatatgaagaaaagccttgtaagccgtttcctgaacagcgtccagtgtatcttccttgtgatgcaaatagagataagctgttttatataaagtctcctgatgagctgtgatcagtttttcaaaggctgcggcatcaccttttttcgcctttttgatcaatcgttcttccttcaccttatccacctcctatgctgttagatatgaatcagggcaaagcggtttcaaaaagatgaaaaaaaacgcctcttttttaaaagagacgtttttttatcttcatttattcccactcaatgctttctaaacattataagaattaatttattgaatatcaagccttttggggtttgtagttccttgatttagaagttaccattaaaaatattgctcccccgtgttctgaatattatgggagggggtaaatactgtgatttagtgttttagttgaccttataataaaaaaagcgcactaaatcgaattgaaaggtgcaaaaacatgattacaaatcaacaattagtcataaacaatttggaagaaaaattaaaatcatttacccatacagttagcggagagcttacaaaggaagaagatttcatcatagcaaatacaaaaatccccactgatacattcaatgtaatattaccgaaatctccaaatatcaaaaatacagttaagatcagacatggaatcgataatttttcatataaaaaatatccctttagtatatggattgatgctcagtatttaactgaggattggacaaaacttatacaagaatatgatctaaaagaagcggaacgtaatgtaatgatgaaacttgaaaatactcttaatgttgggcaaagaatttcccatcagcttatgattactgctgtgaaaaatgatgaagaacttttaaaatatatagacatattcacgagcttatttgagggtacaccagaaaaagatgcactagaaagttattttaatacgttttcacaagtaaaattaggttcagaagttcagatgtttattggatgcatagatgaaatgcctgtaactaccggtttattaatagaaaccaaagatagctatggtatttatgatgtgatgacaaaagaaacatttagaggtaaaggaattggcagtgaaatgtttcaatttcttctaaatcaaacaaaggataaacaaaaaccagttgtattacaggcttcagaggatggaaaaaatatctataagcgatttggatttatagatgtcggagaaatggttgtatttgaatagagggtttctttaatttgcttaatttgaacaaactttattctaaaacaacattaattattatcccattgtggaatactttttctttaaaattcacgattcaattaataatattggatcaattgttgctataaaagaaaaaagagcttagaacccttataaaccaaggattctaagcttcttttgactattcccactcaatcgttgcaggcggcttgctcgtaatgtcatacacgacgcggttgatgtgtttcacttcgttgacgatccgtgtcgaaatcacttcaagcacatcccaagggatacgcgcccagtcagatgtcatgccgtcaattgatgttacggcacggataccgattgtgtaatcatacgttctcgcatctcccatgacgccgacgctgcggatgtcaggaagaaccgtgaagtactgccagatgtcgcgctcaaggccgtgattcgccacttcttcacgcagaatcgcgtctgattcacgaacgatttcaagtttttcttccgttacttcgccgagtacgcggatgccaagtccagggcccgggaacggctgacgccatacgatatcatccggaaggccgagctctgtgccaagcgcgcgcacttcgtctttgaaaagggtgttcagcggctcgatcagttcaaactgcatatcttcaggaagtccgccgacattgtgatgcgatttgatcgtttgcgccgttgcagtaccgctctcgataatatccgtgtaaagcgttccttgcgctagataatcgatgcctttaagcttgtccgcttcatcatcaaatacgtaaatgaattcgttgccgatgattttgcgtttttgctcaggatcagaaacacctttcagcttgtttaagaatctgtctttcgcatcaactttaatgacattcatattaaagccttcgctgaacgttttcatgacgccttccgcttcgcctttacgaagcaggccgtgatcgacgaaaatacaagtcagctggtcgccgatcgctttatgaattaaagcagccacaacagaggaatcaacaccgccgcttagcgcgcaaagaacctgcttgtctccgactgtttcacggattttttgcatttcgatttcgataaagttttccattgaccatttgccttcacaatcgcaaacgccgaatacaaagtttttcagaagatcattgccgtattcagagtggcgcacttccgggtggaactgaacgccgtaccaattcttgtccgctttgctcatcgctgaattcggacagtgatggcttgttgcgtcaacagtgaagccttctggaacttctacaaccaaatcgccgtggctcatccagacaacttgttcttccggaagatctttgaacaagtcaggagttccttgaatctgaatgttggcttttccgtattcgcgctggcttgccgcctcgacttttcctccgagataatgagtcatcagctgcatgccgtagcagatgcctaatacaggaatatctagttcaaagattttttcgtcacagcggaaagatccttcatcatatacactgttcggtccgcctgaaaggataattccttttggattcatttctttgatttcctcagctgtcaacgtatgggggtgcagctcgctatatacgccaaattcacggatccggcgggtaatcagctggttatactgactgccgaaatcaagaacaagaatcatttcattcactaacttcgtcatggttgtcacctaatctcctctaagtttttgacacagaaaaaacggaggacaaacgttcagccctctgtcgcgcaagacttgtccggaagcccggctttttaacgctcccgggctcccatttaacattcatttattctaacaacaggacgatatgcggtcaagactatcttgttttaattatattttcccacaactgtcccgattcattccaaagctccgctgcattatccctgcggtataaggcccgctcatagagcagcgtcagctcggacatgtcgtttgtatggtacgcctcgtcaatcctcgcggcaaaatcgcgcagtgtttctccgtctcccctgctgaatccttttcgtttcagctggcggagcagcgcggcatatgcgtcgaaaaagacgtcttcatccgtacgccgcttcaatctggctgctgtaacgtgcggaatccagcgcgcccggagcacccaggcgagtgccgccgcggctgaaatcacgatgacgatggctgcatacggccatagctgtgccgcggttttgttgtggatcacaggctgcggtgccgcgctgtgatcccgctttttcggcttttcctctttttccggctttgtttcctgacgctgcttgtcagacggttcatccgaatttcccgctgagcctccgctgtcttttgccgccgtatgattttgctctgacgtaaactccgtcggattggtgaagccttttgtcggctcaaacgtcacccagccctgatcgggaaaatacacttctacccacgaatgggcgttgttgtttgtgacttcataaatgtggccgttatggtcgcctgcccctttatattcgccggatgtatagcccttcacccaacgggcggggattcccgcagagcggagcagcacggccattgccgatgaaaagttatcacaatatcctcttttcgtttcaaacagaaattgatcgacataatcctgattgtgctccggaaccgcgacatcctgtgtattatacgaaaatgcggaagatccgagataatcctcgatcgccttcgctttatcgaacatattatggtgatcccgcgtcagtctgtccgcaagctgtctcactcttttcggaaggctgtcggggacctgtaaataccggtcattgaattgattctgctcacggtatcgtttcactttcacttttctgagatcattcagcttaaagacgggcgcctgaaaagtcaccgtgtaccgtcccatattgcggatgttgcccacttgttcactgaccggcgtaatttgctcggtgtttccgttcatttcaagctgaatcgagtgcttcggtttaatattggagacgccgatcggatacatgacgtgattatagagataattttcatcaatggacacctgtgccgtataccgtctcgtctgcacactccggtcaaaccatatatcttccacgttgccgccgttcagtttataggacatgccctgatcggtctccacccagcctttccccgtgtatgtatccttcgtttccacccggaagtacgcccgttcttttcccttccatgtgaaaaccggcgtatcatcctgctgaaaagggccgcccaatgtttcatcatgattgccgtagccgattttgctttcggcggcgggcacttctttgtggtttgttatttttttaagaaacggcacggggtccggccagttcgggtctgatttcggagccgccagaccgaacacgacggaagcgcagataaacagcatcagcggcagaaaccatttgagtatcaatctttttttaaacgctatgtgttccgtaagccggatgcgctccatatacaaaagccccatcatcaaaaagccgataaagacgatccggatgacggcgtacgcggcatcataaggagtaaacgtatcaagcacggtgatatacgccaccgtcatgataaaaaagaataatattttccgctgatagatcacccagtaatgcagcaaatacacgagcagccataaaagcacaaaaaacagcaatgtgcggaatgacggattcatatcattccatcttccggacccgatgtggcgggcattttgcatcacgtcccgcaaaaaagaaacgagccattccggctgaaaaaccgaacctttataaaacaagatatgaatactgatcaacgtaaacagaatgcaggacggcacggtgacgtaccacctcatccggaagaatgacagcagaaatgccaaaccgataaaaacgatgaaaaaaccggtatgttttgtatctgtaaaattgtgcagcggcctgagccattcccataacaataaaaaagcgagaaaataaaacagcagcagactcagcctgcttccctggttctcgtcatgcggcatggcgcgccacctctctttctaaacaacatgggacacccgtttgtccctgatcatttgcaccttaatatttttttgagcgaagatgagagcgagtttccgttctttctccgaaagcgcggcattcgtttctttcgccaaaaacaccgtcatgtcagcacggccgggctcagcctgtttgagaaggtcttctgtaagactgcccgtcacgacggcaatggaagctttgcggacgcgcggatccgccagctcttttcctaaacgcccgcctgcatcggcttcttccgattctgaagctgatgccaggtaacgcagcatctttctgaaatgccggtctccctcccggacgggaaatacggtccggtcgctccccaatgaaataaatcctgcgggagagcccttcacaagcgccgtgtaaagcagggatgccgaagctgataccgcggcttcaaacgatggggacggcctgcagtccaaaaggagagtcatattcacactctgcagcgggtcaaattccttcgtcatcagctcatttcgccgcgctgatgttttccagtcaagtgcggaaaaccggtcgcccggctgataatttctgacgctcgcagccattgcggagcggtgtacctgaaacggagcgccggcagccgcaccctcttctccggatgcggcctgcggcttatagtgaacagacccgtacgccgggaaaaccagaaccgtatccgtaacggaaaacgacgccgtcttgtccaaaagcccgagaacatctcccgtccgcactcttatcgtatgtaaatgatgctctccgcgcggcacctgtggcagctcatattgtaacgtcagcttcctttgaaaccacggaaacacgagctgtttcgcactgcgcctctcgccaagcgtttccggcatcacatcttcaatgaccatatatgtcagcggaaacggcaggcgcctcgtcagcctgatggtgacagacagcctgtcgcctgaggttaactgggcggaggacacgtcacgcgtcacctgaaacgcccgcagcgggtacacagcgaccagcccggcgtaaacggtaaacggcaaaaacgcataaaataaaaaccagctcacaaatccgccctgaaacatggcataagaaaagacagccgccgtcagtaaggccaacataagcagcttccagccatatagaagccaatgcatcttctttctcattagcggaccgacatcctttgaacgggcactttttccgtttgcatgatgtcttctataaccgcttccggggtcacatcgttaaatttcgcctcggcggtcaagatcattctgtgcggcagcgtatacggagccaaatactggacgtcatcaggaatgacgtaatcgcggtcatgaagcagcgcgtacgcctgcgcggctttcattaatgagattgaaccgcgcggacttacgcccagatgtacggacggatgccggcgggtatgctgagtaatgccgacgatatacgctttaattccatcatccacccgcacctgctccaatttttgctgaagactgataaactgttctttagaaatgacgggctcgattgtttcaagcggattgcgcccttcctgcaaagacagaacttgaagctcttcctcggcagtcggatagcccatgcgcagcttaaataaaaaccggtcaagctgggcttcgggaagcggatacgttccttcatattcaaccgggttttgggtggccatgacgaaaaacggctcagccagccgcattgtctttccgtcaatcgtaacattcccttcctccattgcctcaagcagggaagactgcgttttcggagaggttctgttaatttcatcagccagcacgatattccccatgatcggtccagggcggtattcaaattccatcgttttcgtattataaatagagacacccgtcacatctgacggcagaagatccggcgtgaactgaatcctcttaaagtcagctccgatcagcttggccaaagcgcggaccatcatcgtttttccgactcccggcacgtcttccagcagcacatgcccttttgcgagaatggcggccagactgagtatggcgatatcccgttttcctatgatgatgttttcaatatgctcaacggctttctccagcagcggatgcagctcttctttataagccattcttctcctcctagtcatctctcaaatttcaattatcgtaacctaactttaccacaaaatataaacagtataaaaaaacgtttccagcgaattgtttccagtctgaaaaaggaaaaagctccctttagaaaggaagctttatttcagctggagaggctccatatgaatgtgtgaatggtcaatggcatgttcatctttcatcttgcgttctacctcatttgcgatctcatgactctctctaatgttcagatctgacggcacttcaatgacgacatcaatatgaacggagctgcccagatatctcgctttaatatcttttaaacggctgacgcccgcaatctgttcaatcgtctttttataatcagaaatatgtttgacatcaaaaccgtcagtcagcgaatgagaggattccttaaaaatatcccacgcggttttgcagatgatcaacccgatgataaacgcggtaaccgtatccacccaagccaaatggaactgtgaagcaaaaattccgataaacgtgccgatactgacgagcgcatctgatttattatcagcggccgcagctgaaagggcctggctgtttacctttttggcaagccctttcgtatagcggcagaccatcagcatcacgacggcgctccccgcggccgtccaggcggctatcatatccggtgtttcctctttaacggaaaaaatagattgtgcggcgctgaacagcacttgcattccgacaagcatcataataatggaagcgatgagtgacgcgacggtctcggcccgaaaatggccgtaaggatgatcttcgtcaggaggtttctgagagatgcgcaaaccgatgaaaacagccgcagatgccgcgatatcagtcgcattatttaaaccgtcggcctgaagcgcttctgagtgaaacaaataaccgatcacaagcttcacagccgacaatgccgcatatgcgccaatactgacaatcgctccggtttcgccttttttcaattcatgatatctctccactgaaaatcctccttcccgttcaatttttccttcattatcatacaaagcgaggacacagtgggtctatagaaacatgattcactttccacagaaaaatagtaagcatagaacatttatgcgctcaggaaacttatttttattcacgaaaaacctctcatcccaatcgtatcaaggattctcgccaacccatgttcatggaattattttcaaacccattaaaacacaaaaataacagaaaattatttcttttccttccggcaccttctgctgtacggacgagaaaaaatgtcatattttcttacatcattttcaactgtctgtggcatttatgatagaataatacttgtcggaatattcagcataaacaagccaaaaggaggcaaagaatgaatcagcctaactctttatcaaagggattaaaaacccggcatatgactatgatttcaattgccggcgtgatcggcgccggattatttgtcggaagcggatccgtcattcattccaccggacccggagcgattgtctcctacgcattagcaggactattagtgatttttattatgagaatgctgggggaaatgtcctccgtcaacccgacaagcggttcgttttcacagtacgcgcatgacgccatcggtccttgggccggttttacgatcggatggctgtattggtttttctgggtcatcgtcattgccattgaagccattgcaggcgccggaatcatacagtactggttcccgggcattccgttatggctgacgagtctgcttctgaccgtgctgttaacactgacgaatatttattcagttaaatcgttcggcgaatttgaatactggctttccttagtgaaggtagcgacgatcgttgtcttcttaatcgcgggatttgcgttcattttcggaatcgtccccggcagcaaaccggtcgggctggaaaatctggcgggcagcggcggatttttccctaaaggtccaagttccgttctgctcggcatcgtcgttgtcattttttctttcatgggatctgaaatcgtcgcaatcgcagcgggagaaacgtcaaatccggtcgaatccgtcacgaaggcgacccgctcagtcgtttggcggatcattattttttacgtcggctccattgcggttgtggtcacactgctgccgtgggattcagccaatattttggaaagccccttcgttgccgttttgagccatatcggggttcccgcagccgctcaaatcatgaattttatcgtcctgacagccgttctgtcctgcctgaactccgggctttatacgacgtcacggatgctgtattcactggcagagcgaaatgaagcgccgcggcgttttatgaaactgagtaaaagaggcgtaccggttcaagccattatcgccggcacctttttctcctatattgccgttgttatgaactacttttctcccgactccgtatttttgttcctggtcaattcatcaggggcgatcgcactgctcgtctatctcgtcatcgccgtctcgcatctgagaatgagaaagaaaatcgaacggacaaaccctgaatctcttaaaatcaaaatgtggttttatccgtacttaacctacctgacgatcatcgccatttgcgccatcttgttatctatgctgtttatcagttcaatgcggtctgaatttctgctgacaggatttattactctgctggtacttgcctcatatgtattccgcaaaaaacaaaaaccgaaagagagcgcttccgaaagccggattgcgcaataaccgcaaacacccccctcaaaaaagggcgggtgtttttttaaccaacctgttccaggcagcattaactgtagtacaggatttcaataaatgataaggacaggatgaaaaatggcactagaaaaatttgcagatgaactgccgattatcgaaacactccagccgcagaagaaatcagacggcagcacgtattatgaagtcaccatgaaggaatgctttcacaagctgcaccgcgatctcccgccgacccggctgtgggggtataacggtttatttcccggcccgacgatcgacgtgaaccaagatgagaacgtctatattaaatggatgaatgaccttccggataagcattttctgccagtggatcataccattcaccattcagaaagcggccatcaggaacccgatgtcaaaaccgtcgtccatttacacggaggagcaacgccgccggacagcgacggctacccggaagcatggttcacaaaggattttaaggaaacgggtccttattttgagagagaggtataccattatccaaacaaacagcgcggggctctgttatggtatcacgatcacgccatggcgattacgaggctcaatgtgtacgccgggcttgccgggatgtatatcattcgcgagcgaaaagaaaagcagctgaagcttccctccggagagtatgacgtaccgcttatgattttggaccgcacattaaatgacgacggttccttgtcttatccgagcggacctgctaacccttccgaaacgctgcccgacccttccatcgtcccgtttttttgcggaaataccattctcgtcaatggtaaagcgtggccgtatatggaagttgaacctcggacatatcgtttccgcatccttaatgcctccaatacgagaacattttctctctcgctcaataacggcgggaagtttatccaaatcggttctgacggcggactgcttccccgctctgtcaaaacacaatctatcagcttagccccggcagagcggtatgatgtgctcatcgatttctccgcctttgacggagaacatatcattttaacgaacggcaccggctgcgggggcgacgccgatccggatacagacgccaatgtgatgcaattccgcgtcacaaaaccgctgaagggagcagacacaagccggaagcctaaatatctttcaacaatgcctaatgtgacatcaaagagaatacacaatatcaggacgcttaaactcacaaatacgcaagacaaatacggccggcccgttttgacgctgaataacaagcgatggcatgatcctgtgacagaagcgccgaagctcggcacaacggaaatctggtcgattatcaatccgatggggggaacacatccgatacacctgcaccttgtttccttccaaatccttgaccggcgcccttttgacttagagcgttataacaaattcggcgacattgtgtatacaggccccgccgtcccgcctcctccaagtgagaaaggctggaaagataccgtgcaggcgcactcgggagaggtcatcagaatcgcggcgaccttcgctccttacagcggacgctacgtatggcactgtcatattttagaacatgaagattacgacatgatgagaccgatggacgtcacggataagcagtaaacaaatatcaccccttttagagaaggggattttttatttatccaaaaagaaaaaataagaagacacttatttgcatatactgtaataacaggaagacgatgcaccctcattggaaatctggataaaaaaaggaattaggagattagggaaaagtatgagacaatgaaggagtgcacgaaaattcataagggaagaagtgactttatgtcttactacaacaaacgtaatcaggaaccgctgcctaaagaagatgtcagtacgtgggaatgcacaaaagaggactgtatcggctggagcagaaagaattttgccggcagtgataccccgacttgccccctttgcggcagtaaaatgatcgacggcgtccgttcgttggtaaatctccaaaacaataatcaaacggcatcaagttagacctcccttttacgagtctcaacatagagaaggcctccatgtctcatgagaggcctttgcgttatcatttccttttatgatgcaaaggagcaatgaacatgaaaaacgatcggcagcagaaagatctgaaggaaatggcaaaacggcggaaaatgaaccttgccgcacagtcattcatcgaaacgcttcattttgccgttccgattctccgttttttcaaatggctcgcctcagccgcagccagctttgttcattaaaaaacacccagcgggcgctgagtgtttttttcatgattggatgacggaaaaactgttgataatgccgttgtcattttcccagactttttcgcattttttcgtatccaaatgataagcataaatggtccggaccttcgcattccgccccgtttcatccttcagacgcttagcgccttttgcttccgccatgaaataaatgatgctgccgtctttagaaaactgaggctgggcatcaatcagcggagcgaagtccttcccgtttgagataatcgtttcatcttttttcgttttgacattcatcagacggatggacgctttttgttccgtccctttttgggtataagatgtaaagacaaagttctttccgtccggtgacaccgccacgtcgctgataaactgttcaaggtttgtcagatcctgaaggtgttcgcccgctcctgctgcaaaccggatattcgtcggttcagggtcaatccccttctcatttgcctcatccgttttttgataatcctcttttacagaataatgcagaagcgcaaaatcgttttggctgcggttataaaagaagctgctcacactgtcgtctttctcatcggcggcgggatacagattttcataacgtttcgttttcaaatcaaaagatgcgagacggaaaatatcttcatccgcttttccgagacggaaataaatgtgcgtcagatcctttgataaaaacagactgtcagcgcttgccgttcctttataaagcaccgtcttctgtttcgtcttcagatcaagcttatagagacgcatctcattttggtcattattcccgacaaaatagagcacctgatgggcgtcatccagcgcaaacgccggatatgccgaaagcttttcctcgtacagcacgcggccgtcctcgtaatatttcgtcatcagatctttgtctgtaatggaaacaagcagcttgtcatggccgccggagacaacggctttcccgccgccgtcgctttttcctttaatcagtaaaacggacgcgatgaccgccgccgccaaaacggcagccagcaacatccagatccatcgtttcttcttcattatcaatctctccgtcaatcagaaaaagcaagaatcagtgtccttgctttttaagatggtctattttaatagctgtagtgtccggatactcttcctttgcttaatggatatccgagcgctttgaacgctttcgggctgacatccaatacggcattcggcagacggcctacatcatttttgtatacggtgataacctttttcggttttgctttcgcataagctctgattttcgttccgtttctcggaacgtcaaatcctaattttgtcgcacaatcccagtgtcccagttttttaccggaagatccttttttaccgactccattataccatgtaatatttccgttcacttttttagcacttgcatcagaagagtaactgatcgctcccagcgtgcttcctgctaaaatcaataaggctaagaataacttcttcaagctttcgtcctcctgattctttattctaggcaaaattatacaccaagaagacgattataatatttcaatcactttacatgttcattacaacgtgatgagacatgcacataacgacggcacaatttcccgttctatataattccatggtaaattatactacaaaatttaattcattagcgttataatattcatagagtatttctgcattcaatatggactttttataaggcctattgatagttgcataatatgatatattttgagaaatcaggctttaggaagcaggcactttattccttttaaccgtggttcatattgatcatgtacctatactcgtttcaatcagactaggagtgataatcaatgaaagcggcaagatggcacaatcaaaaagacattcgaatcgaaaacattgatgaacctaaagcagaaccgggtaaagtcaaaattaaagtcaaatggtgcgggatttgcggaagcgaccttcatgaatatttgggaggcccgatctttattccggtcggcaaacctcatccgttaacaaacgaaatggcgcccgtcacgatgggtcacgaattctcaggagaagtcgttgaagtgggcgaaggcgtcaaaaattacagcgtcggcgaccgtgtcgtcgtggaaccgatttttgccacacacggacatcagggagcctataaccttgatgaacaaatgggattcttaggcttagctggaggcggcggcggattttctgaatatgtatccgttgacgaagaattgctgtttaagcttcctgaagagctttcttacgaacagggcgcgcttgttgagccgtcagcggtagcgctttacgccgtccgccaaagcaaattaaaagcgggcgacaaggcggcggtttttggctgcggaccgatcgggctgcttgtgattgaagccctgaaagcggccggcgccacagatatttacgcggttgaactttcaccggaacgtcaggaaaaagcgaaagaactcggcgctatcatcattgatccgtcaaaaacggacgatgtcgttgaagaaatcgctaaacgcacaaacggcggcgttgatgtttcttatgaagtaacaggcgttcctgtcgttctccgccaggcgatccagtcaacaaacattgccggtgaaacggttatcgtcagcatctgggaaaaaggagcggaaattcatccgaacgatatcgtcatcaaagaacggaccgtaaaaggcattatcggataccgcgacatcttcccttccgttcttgcattgatgaaagagggctacttctcagcagataagctcgtcacgaaaaaaatcgtgctcgacgatctgattgaagaaggcttcggcgctttaatcaaagagaaaaaccaagtgaaaatcttagtcaaaccgaactaaaccgttcagctgaatatcagacacatccgaaaaagagccgttccggctctttttttcatctcatcgtctttccttccttttccttttaaaaatgatcccctctgcgcaaactattttttaccctgtcccgtctatccttaggcaacagcctatgatacgtattttaaaaaaaggagccctttgaagcaatgaagaacgaaacagccaaagcgtcgcttgtgacgtgcataactgagcgcaaggaagacttttaccggctggcgtacagttacgtaaagaacaaggatgacgcgttagatattgttcaagaatcaattcaaaaagcgctgacatcggtcgaatccgtcaaaaaccccgatgtgatcaaaagctggttttataaaattttagtgcgcacggccattgattttctccgcaaacagaaaaaactgaaagtgatggatgatgaaacgatcgagtttttaagccgaggaaaggaagatcactacaaggacacagaccttcacgaagcgcttgatgacctgccgcatcaatataaaaccattatcattctgcgtttctttgaagacctgaaattagaagaaatcgcggacatcacgggggaaaacatcaacaccgtcaaaacacgcctttacagggggctgaagctcatgcgcattcagctgacgaaggaggatctttcttaatggaaaagagattagaacaattaagagaagagtataaaagtgtgcccattcctaaggaactggacagcattgtcgaaaaagcccttcagcagaaaccgaagaaaaaacgaatcgtgatgtggccgacatccgcggcagtcgctgcggccgtcttatttaccgccgttgtcaatatcaacccggatgccgcacaagccatgtctaaaatccccgtcatcggcaaagtcgtccaagccatcacattcacggagatgaaggaagaaaagaaccaatcaagcattgatgtgaaaacgcccgctctgtccggcctttccgatcataaactcgaagacagcatcaaccggcattatatgaaagaaagcaaagagctgtatcaggaatttatgaaggcgacctcaaaaagcaaaaaaggccacctcagtatttacagcgattatgaaaccgttactgacacagcggatttgatctcaatccgccgtgatatcgaaaaaacgcaagcttcctcttatacgcaaagccgttacatcacgattgataaaaagaatgaggccgtgcttacgttaaagagcttatttaaagatgaccgttatattaaagtcatcagcgaaaatattaaagaacaaatgaaaaaacagatgaaagaagatccgaataaaatatactgggtcgaagataatgatatgtcggagccttttaaagccatccgcgccgaccagaatttttatattacagataagcacaaacttgtcatctcatttgatgaatacgaagcggcacccggatatatgggcgttacagagtttacaataccgacctccgtcatctccaagctgcttgtcggagaccgctacatcagataaagaaagaaaaaaatccatgatatccgcagatcatggattttttctttcgtcccgcaacagccaagatgcacaagggacccttttcatatatcagacgccggacgggggctgaaaagtttaagaaaatcacagcatttcattcattttttctgaaacaaaatccccttccgaatgcgtctaattaacggaacaaatggaagactgtacagaaatctgccatagccatccgcaaaacagcgagaatttccgcacacattattggaggaataccatgtcagacaagtcactgcatcaccgctatattcccggactggatggacttcgcgcctttgccgtcctcgcagttatcgcatatcatctgaattttaactgggccgacggcggtttcattggtgttgatatcttttttgttttatcggggtatttaattacatctattatattgcctgcccaaggcaatgccatcacccttgatttgcgtgatttttgggtgcgccggatcaggcggcttctgccggcggcttatctcatgattatcacgacggtcatttgggtcgtattgtttaacagcgagctcctgcataccgtacgcggggatgcggtctcctcacttttttacataagcaattggtggtttatctttcatcagctttcttatttcgacagcttcggctccccttcgccattaaaaaacctttggtcgctggcgattgaagaacagttttatatcatatggcccttcctgctgcttgcgggaatgtacatatgtaaaacacgggcccggcttgcggccgcggtcatgttcctcgcgttatgttcggcagtcgtaatgagtatgatgtatgtgcccggcggagatccgagccgcgtttattacgggacggatacccgctcatttgaattgctgatcggctgcgctttagctttagtgtggccgatgaaacgattatcttccaaacggctgccgagcagcatgaaacacctgcttcacgggacggagcttgccgcttttgccgcgctgctgctttgcgtcttttacacggatgaatatgaacccttcctgtacaagggcggcatgcttttgatcagcatcaccgcagcggttcttgtcgcatgtttatgccatccgagcagctttttgggacatgttctttcatggaagccgcttcgctggatcggaacgagatcatacggaatctatctttggcattacccggttttcgtactgagcacacccgtgcaggaaatcggaaatccggtttattggcactgcgccgtcagaatcggcgccactttcattcttgccgagctgtcttaccatttcattgaacagccgatccgcactgcgggcttccggccatttttacgccgcgtgtttctgaaccgctttttggaatggaagacgtcctctgtcatcagcagaatgtcgctcggcctcattcttgccgccattctcgtatttgcgggcgggctgtcaggaatagccgaagagaaaaaacagccgcaatggacgtacgcgcaaaatgatcagcaagaaaccgccgcctcttcgcacaagacggccgatcacgatcaaccggcaaaagaagatgacagcaagaaaaaacacggcggcgaaaaaacggataccgcgtcagacaaaaacaagaaagaaccaacagacaaatcaaatacaaagaaaaacgaagagaaaaaggaacagtcatctcaaaaaacggctgatccaaaacaaacacagcctcagcaagacgtgctggccatcggtgactcggtgatgctggacattgcgtcatacctgcggcagtccctccctcatgtcaccatcgacggaaaggtaggaagacaagtctctcaagcactccagctcacttcggaatatgcgtcatttaatcagccggacaaagcggtcatcatcgagttagggacgaacggctatttcacaaacagccaaattgaatcactgatcagctccttttcaaaagccgatatctatcttgtcaacacacgtgtgccgcggcagtgggaaagcaaagtaaacgaatcattgcgccggcaggccgagtcacggaaaaatgtgacgcttgtcgattggcacgcaaaagcattgcagcaccctgaatacttcacaccggacggcgtccatctcatacctgaggggtctaaagcgctgacatccctcatcgttcaaacaatgaaatcatgacaaaaaaaagaggccccaaaaaggcctctttttcgtatatcgtcaggcaagcttctgtccgcaattcgggcaaaaattcgcgccttccgttttcgttccgcagttcggacaaaatttcggcttagccgctccttccgagccgttcgccggtgccgtcccctgattctgctgactttgattttgctgcggctggttctgctgattttggttcatttggttcatcatttgatttgccgcattcattcccatcatcatgcccgccatgtctgaggcggcgccgcttccgctcattttgccggatgacattccgtccgtcatggaaatctgctgatagcggttcacatcgcccaccatgccgtaagaagcgtttttcgtaatcatatcctgaacttcctgcggataattaaagctcataatattgaagcccgtaatcgacatgccgtctccgatcagctgcatatcaagatcttcttgaatcccttttccgatttcaaaggaattcgactgcagattgaacatgtcttttccttctctggtgatccatttcatcaaaagctgatcgagaatagacgtaatccggattttaatgtcctccactaaatagctgtctttgacacccgcaaccttatcaatcaatccgatgtagtcaatgaccttgaagttaaatgtgccgtttgcgcggatcggcataccgcccggcatacctgccgccggaatgttgatagcgttttttgtgccccacttcacggtgaactccttcgtattcacaaacagcacttcagcccgcatgccgctgttaaagccaaacttaaacccttttagtgtagatagaaacggaatgatttctgattcgatatcataatcgccgtcatcacggaaaatcccttcaatcttcccgttgtataaaaagatggcatcctgtcccggccggatgatcagacggctgccttttttaatttcacggttgttccatttatagaaaaccatgtcatctctgaattcttcccattccaccacatttgctaactgatttctgaaaaaacccatgtatgctcaaatcctttacatataatttaaaaacttcccttgcttccgctgtaactcgtgccgcccctcgtgactccgccgtcattgtcattatctttatcaggctttttttctcttgtaacgtcggttcggatatatgtgtcgtgctggctcagcacttcagacgtatcgtgattcatatacgtgctgccggtgacggtgaccttgccgccggaattgtacaccatcacggtgacggcgattccggccgcggctgcggcaataatgagctgaaaccaccatgtgagcagcagattgtcagacttgtcgtccgggcttttccccatatctttataagccatcttgatgtaggtctgaaacgccttttcataatggcctgcggaaatatctgacgagatcgtatttctgatcgtattcagccggctgttattcaaatacgtctccgcctttttatatccggagataaatacttcccgatttttcatatcaatggtcaaaatcgccgtgcttccgctaaaatgactgtcataaaaatcaccggcgtactgctcgatgtccttaccgcccgttccgtttgcggtaagaatgataaaatcggtatggcgctttgccccgagcttcccggccaattcctcaagtttcttcgtttcatccttcgttaataaatgagcattgtcataaacatattgcttctgttccgcggcagacgccgatgtatgtaaagaaaaagacatcatcagaaaaaggacgaaacagaagagacacgctttttttatcgatactttcatcaaaaaccgcctcctatcataagtgagacgagtcttaatgctaaaaacgcaccggcggttatgccgccgaaccacgcggccacttttccggcactgatcggcggtttgccgacaaccttgcccgtctgcccgttcatcgcaaaaatgtgctcagcccgctcatagtcgtagctgaccatccagaccggaagcagtacgtaaaagctgctgattttatcggtctgaatctgctcatccgtaatgtcagccgtcgtatatccggagaaggtggatctgatataagaatcaatataatggctgattttatccttcgcccgcggaaagagatcgtcatcggtataattgtacttttccgcaatatatcccgctaaataggccgtattaaactccttcagctcactgtatgagtaaggctccaatttgtccattaattcatcattcattttttctgaagcgtcgaccggaattttgagataatcaagattgatatcgcggtacgcgttgtaatattcggtctccgtcacccggtattctccatcttcatagtgatgcactctcgtacaaacggcattgacctgaaccttgctgtttaaatcaaacatccaaaacggcacgtacatgcccgttatgctcttcacccgatcggcagacataaatcctttcggtgtcagccggccgtttcggcaccactttttaaaagcgctcatggcttcttctttactgatcgtaaaaggaatcaccatcgaaggcgcgagatttcccgataatcggtcggcgagaacggcggctcctccgcaaaacccgcacgtcgtggccgtcgtttccgcctcagtcattaataccgcaccgcaattctcacagcggtactcgttcgcctcattttctgaaaatctcgtcgttatatactcttttggcaggctctcaatctgatcctgccgcccgcagctatgacatgtcagcatgccggatgaactgtcaaagaccatatcatcgccgcagttcgggcatttataagaaatgatcattctgtttctctcactttctctttatatcggacaaagctgcagcccgctgtctattgatctttactgaaaagcattttctgcttaagcgccgccaattcatcatcgacactgctttgattgctgtcatatttagccgtcagatcgtcaatatcgtctttcggagacgcgttcagctcagccatcgcattggcatgatcaagcgcttggttgaccttgtcttccattctgccgaaagctgtcatcgattggcccgcatttgacacagaggaccccaatttgttcattctctcctgcgtttttgccacagaccacttcgctttgatggcatttcggcgcgactcaagctctccgatatcagcgacaagcttgtcatgcattttgcgcatttgagaggcgttggaagaagcgagctgataagccgtctgcagctcggtcagtcttgattcaacagccgctttcctttccaaaaatgtccgcgcatcagcttcattgccggcctgcaatgctttcatcgcataattttccatcttttcggcatcagcctggcattctgttaacgctcttttcgcccgctgttcctcagccatgacagaagccgtctccgctttcacttttcctaaatcactgttcagattccgcaaatattgatcaaccattttttcagggttttcagctttatccagcatcgcattgatattgcttgacatgatgtctttaaatcttcctaaaatactcatttttcattttcctcccaaaattaaatagtaacaagttcacagttatctatactgtttttttcaaaaaaagtttcattttctctttaatttatgtatttttatatgaaaatagtctcattcagcccatttgtgccggcggtaattctttatgaccagatacagtgagaacaaaaaataaacaaacagcccgatcatcaacccgctcactaacggataatgtttcgcagcatacacaaagaaatcaagctgcgaaatctgttccggacttgtaatcgtatccgtcccattcaaaagctttgaaaatttcgccgtatcattccaatcaaacgaatcagaaacaagctcactcccctgataccaattgacagcggcgagacataaaaaacaaaaaacagaaaacgcgcattgcacaataagaaaaacatgtttcatgaaaaacattcctccgcggttcaatatcataggccgtcacactgtacatgacggcagcagcagaaacttggttttactcagaactgataaaaacgtgattgtatgtacttcacatcggttcaatttactggatgcctttctaaagtataccgtatatcgaaaagggtttcagacctaaataaagaggatgcttcccgaagtccgatgactttcaagaagcatcctcgatattttacagagtcactccaacctcttttaagctcggcaaagcatcaatcgcaccgattttagtgcacacgagcgcccccaccttattggcaaatgagacaatatcacgcagcttcgcaaaatcttcggctgccgtctgaatctcatccgtgcgcgccagctgatacagcgccgcgccgacaaacgcatctcccgctcccgttgagtctattgatgtcaccggaatgctcggaatgatgtcaatatccttcccatttgaaagaagggtaccgcttttcccgagtgtcaccgcaacaatgccggccccgagctcatgaagaaccgcaacaccttctttatgatccttcgcaccgctgatgatctcaagctcttcgtcactgactttcacaaaatcacttacggcaacggctttttttgcggtgtttataaactctgaaactcttcctttccataaatcctcacggtagttaggatcgaaggaaataaactgtccattgtctttcgcaatcgacatcagccgtaaataggctgagcaaaacggatcagataacaatgccgtcgctgacccgaaatgaaggattttggcatcgtttaccttttccagatcaatatcatccagcgtaaacaaagcgtccgctcctctgttaaacacaaagtcgcgctccccattttgttttaatgaaacaaacgcaagcgttgtaggcgctttctcatccatgacgagcatagaggtatcgacatgtgcggcgtccaatgtctgcttcagaaaatacccgaacggatctttgcctgtttttccgctgaaagccgcgtctccgcccagcttagcaatggctgccgacacattcgccggtgcgccaccggcactttttaagaaattacgcccttccgtcaaatcaacatccacatcggtacaaaagaaatcaattaacaattctccaatacaaataacagattggcttcccacattatcacactcatttatcaattctcgattatagtttcagtatagtgctttctgtcataaatacaaccgtttacatagaatattttaaattttacgtatacttatctggcagccctttgttccagatcagacatcatctgctgatattttttttcagttaaaggataaaaagaaataagaataatagacagcagaatgaacaatcccgggatgagcgcattcatatttttaatcgcattcaatgacgaggccgtctgatcggtattcgcggcatatccggcgattccgagataaacggccgaaaatgacccggctaacgcaactccgagcttattgatgaaactcatgctcgaaatcaccacgccatcagcccggactccggttttccattccgcataatcgacacaatcggcaaccattccccaagcaagcgtatttaaaggcgtcgtaaaaaatcccgaaacgaaaagccaaaagaaaataagcggcagcgaagaatacgatgtaaactgaaggcccgcataagaaatcagcgatagcgccgccgtgatgatcataacctgcttccggccccgcttctcagaaaagaaaggaataaacagattgctgatcagcgctgcgccgaaaaacaacacggttcctaaaaatacaaattccttatggctgacgttatacgtaaaatagtacaccatcgtgctgagcttaatgttaaacccaatcgcaaacgccaaaaatgcagaaaccaaaatgagcaaaggcttgtttcggaacaaaacggacaacgtttttttcattccttgtttttttcttttttcaggctgaatccgttcccgcacagtaaagaaactgaacagattcaacgcgatgctcaccgccgcatagataagcgccgtcatctgaaatccgaacgcctgatctttcccgccgatggcgtccgcaagcggtgtcgcacaggaaatcgataacagaattccgatataaaccaaaatcatccgggtcgtcgtcagaaccgtccgttcctccacggaattcgtcatccgacccgttaagctgttgaccggaatcgtctgcatgctgaaggacatcccaagcagaatataagtgatgtacgcataaaccatgttccccgtctcgccgaaatgaggggtcgtaaagcataaaaacgtaaatagcgcaaaaggaaacgccacccacaaaagatacggccttgcctttccccactttgtattcgtcttgtctagaatcacgcccataatcgggtcaaaaatagcgtccagcacccttacgataagaaacaaagctgcgatgaccgcaggcttaatgccgccgacgtctgtatagtagaataataagtatgcgtttacaaactgaaagataatattgtacgacatatcgccgaatccgtagccgatccgttccatccaggacaggccgcgatgtttcgtctttactgccgctgctttttctgtttcaatcatcatttcccaccccaagaatccgttttcatttttgataagcaagagggagaatgcaaagatcctccccgttcactcagcgatttggatacaccatcacttttaagcattcatttttgtattgaaaggcccgttccatcgcctcttgcgtctgctccagcggatattggtccgttacaagatgcttcgtgtccacaatgccggaagcgagaaattcaattcccttcggatacgtattcgcataacggaagattccgtatatatcaatctcgttatctgcaataaacggcacattgagcgggatctcgttctgagaaggcaaaccgacaatcgccagttttccgccccggcgcacggaagccagtgcggattgcaatgccgccggattccccgctgtttcccaggcagcatcaacgcctctgccattcgtgatcgttttgatttcttcaccggcatcctgttcccggacattgatgacatgcgtcgcgcccatttttttcgcggcatctaaccgcagcggctccaagtcggtcacaatgattgtgcctgccccgtatgctttcgcggccgcaacggccatcagccccacagggcccattcccatgatcgcaaccgtagaaccgggctggagcttcgttctcgcggccgcatgaatgccgacagaaaacggttcaatcaaagccgcatcttcataggatagtgaatccggaattgaaaaaacaaagtcctgacgcattttaatatattggacaaacgcgccgtcaaccggcggtgtcgctaaaaactgtacatccggacaaagattataacgcccttccttgcacgcctcacagcgtccgcacgtgacaccgggttcgacagcgacccggtctcctattttaaattgatcgactgacgatccgacggcggctatttctcccgcgcattcatgaccgaggataaatggtttttccactacataattgcctattctgccatttgtatagtaatgcagatcagatccgcaaattccgacagccatcaccttaatcaacacttcatcatgattgatgtcaggcacgggcaatgtttcgattttgatttctctcgtgttgtgcataaccgccgctttcatattttgaggcactgtgtgagtcatttggcaaaatcctttctctgctttgaaatgtaagtgcatacatttttgttttctctattactgcccctattttatctgcttttccatacgtacaacagcctttcctgctgtataaaaggacagccgcactgtactttttattttttcatatacaaaaaacactgaattgataaaatagtactaataggaggtgcaggctaatggctgaacttgaaaaccggacacattttgcagaactgctggcacctgccgtcaaatcgctgaaacttcatcctgattataaagtcagaaggaaaaagaacgaaaaaacaggacagtcttatatagatcaaatcgcactccgattaggcgtttcctctaacacgatcaaaagctggatcggacagatgggcggaaactacattcccggacgaattgacgacggaaagctgttcggcatgatctggatcattatagaaaagactgatatggattctgaatggctgaccgatcttctggaaaccaccaccatacccgtcatcaaacccgcattgcccgtttggacggcgtcttgtctaaaaaaagcaaaaatactccggaaagacggatcattcggagcgccgagtgatgaagatgttgaaaaagcagtaaagcggctgtttcatgacagacccggccacgaaacgaatgcgcttacaagaaagtccgtcacgcataacttaccgtcacgccggacggggaactttatcggccgctgctttgatatagaggcgattcgacaatggatgctgtctccgtcaccggtctgtttaatcacaggctgggccggcatgggaaaaacaacgctcgctcttgaagcagcctacctttgtgccggcggttcaccagattggccggcattcaacagcatcatctggatcagcgcggactggaaaggattgagcttcagcgattttttaaacacgatcgcctatcagctcggacgcaccgaacaaatcgataaatcaatcaacgaaaaacggttcgtcgtccgcaatgcattagccgctcattcaaatgaaaaaccagtattgctgatcgttgacagcattgatacagcggaacgtcacattcacgaatttatcatcggccttccgcaaggcgtaaaggtcctccttacggcacggaaaaacgtaaaacaaacataccgggacggcctcggagaactggcggccatccagctgagcggccttgaacaaacggatgcccttgatttttttcatcaagaagtgcaccgctgtttgcaaacatgcaacctcccgcaaaaacgggaaaagctggagcagctgctgcggctatcgcctgcccttaagaatgaattcatctcggcagccgccggcaacccgaaggccatggcactcagcgtcgcttacatgtcagacgacgatatccccgctccccagctcatacaagaacttaaacaagcgggctactcattattggaattgtttgaggttctctttggccgcacatgggacagatgtcatgaagacacacgaaaactatggcagacgctttgctttttcgctaagccccctgatgagaaaagcttggctcaagcagccggattagacgtccggcggtttcattacgcgattgagcaaatgcggtcatatgctttaatacagccggaacgaggcgaaggaagaattcaatacgcagcccatcaaaccgttgtcgcttacggagaacagcacttatccgaaaatcacgaatttgcaaaagaagcccgcagccgctgggcgcattattatattgattatgcggaaacccatttaaaacgggaacggcccaattctgtctattggagctatctgttgggacggaatttagagcaaatgaaaaaggaatggccgaacatcctaaaggtcatcgaatggtcgggcgaaaccggacaacatgacatcctgattaaactcatcatccgcatcagccattttctaagcagaatcaacctgcccctgcgaatcgaatacggattaaaagccgccgatgccgcccgtcaatcaggcgaacacacgcgggaagcttactttcggatcgacacggcaggctgggcgctgatggaagtcaacgattcagacggagctctcaggcaaatagaagccggcctgaagatactcgaacaatcaggcgcgccggatcacgacgacttgaaagtatggggaaccgccctgcaatcgaggctgctgttaaaaatcggagaatcggacaaagcggcagcaatgctggacggcatcaaagatcagcccgtctcgcccattatccggcacagggttcttctggtccgcggcgacctgagtttcgcccgctctcactacgaagaagccatcacattatacgaagcggcaaacaaaaccagcgccgcatacggcggcgaaaaaacgatagaagcctatttcaacctcggcatggcttacgtcaagtgtgatcaactcgaaaaagcggaaaaagcctttgaacaaatgctctatgacaaacacaacgccaatcaagttgaactgatttactatcattacggaatggcacagctgttgtatcgaaaaggagaaactacgaaagcgatagaagctaatcaaaaggcgattcgtctgattgattcgtgggagcctgggattgggattcggggtggggttgagagattggaaaaggtgattaaagaaaacaactagtacgcatagtagttctgtcatcaatctcactcaatttcttcattataaataggaaaggccaattgaagtcgcagttggcctttcgtttcttattaaggtctacaaatgtattgaatcaggttttcccgtatgtattctttctcgtataaaggaaagcgtatcatttgccagctttttgcgacaaagaacaataccggaatggccacaattgtagacaaatcttgtaggtttcccccaactttcccataaataatctgcatcttttaagtcaatatattgatcgtgttttgcagaaatcagcagaatgttatctttattaactttaggcaaggcttgactaggatttgtgatattccaatattttattaaatcttcataggtcacaccatcttgttctaattcttctcttatgtatttacctgggatcgtgttccatatcgaataagaaaggcgattggcataaaagattgataccactacatcaatttgagattctagggtagctattagattagtgacccatccccctaggctgactccaactatgataacaggcccttttttatttgcttttatccagtgaattaacgcccgtaaatctacaatagcctgtcttgtcgactcaattgtacgatcaatgtttgcactgatcatcaactcgccactatacagtgaattttccggttctctttcaaaatggtatggaagagaataataatacatattccagcctaaatccttcattatacggttatgaaagatttttttaattctatcgtacgaatccatgcgccagccgtgtacaaagataacattgggttgatctatatcattttcatttaaataaacctccccttttaaagtatcattaacaggattcccagattgaattaaggattcatagctaaatgttccaaccctataactttttttagattcattcaaattgaatgaaacatcagctgtatttgcactgtaaaattcctctctatcatcaatatcggctgtaatagcagcagaaaaatgtttatctttgcttctttttctgtgtaaatcatataaagcaaagcgatctatcatttttgataaatgcactattaagtcctccttgattatcataaaaaataatatcagagttgataattgggttgtctgtctccatagagttgggacatagacattttaacaggatttctatttgacagtgctttcctaggggaaaccgtctaagagggttggtggcactatttatttagataactgggtctttttcttttcggtaacaaaatctgtttcggttatcggcagaataaagagaatctctccctggtttgcgatcatgaaattgcatatgaagattctaatggagctttgagtgatatatgtgattcatttaccgagttggttaataagctctacgaggaatgaatggatatagaaaatgaccaaacataaataactcaattgccccttccctttgtggataagggcaaataaagcatgtgctgaaaaaatcaaaccataaaagacctctattttgaaagaatctcctgatttcttttttacaaatttattcggaaacttttattccaatgtccttgctacagaagtaatgcccgaagagaaattgcctgaccgcgcatacattatcgacgtgatgtaaaacagagaataaacctcaaaaattagggagaacatccaacaacatgctctccctttttttcgcgaaaaattattctgctgtcactttatacaccttactgagaggtccagtgaagagttccttcgcggatgtccccgcaaatgtctcaatagcattctgtacatgtggaagcattaggtctaggtaacgaagttcgctgcccttcttatcagcaactacctggacggaaccaaacatatcaggatggtccttcagatatgtgacgtatcccttcagctttgcaacgctgtcgccaagccaatcgccgtgtgggtcaacaatcgcaggaacaatactaccgtcgttcaacttctggaagaagatgaaatcaggatacatgttctcccatacgctgttcagcatgtatgggatcaccagcgaagcattcaagtttcttgactggttcctgtaccatgcaacattcagcgagcgagaaagctctgttcgaacgaccttcttctccaaatcattcagattcatatatgcccagccatcctcatcactgataatgtgcttcggataagcatcataatccttgttctgacgagtaatgctggcctggatgttgagattacgttcgatataaggcttcgtgttaccttcgatgcgctcccacttctccttattctcttcagacactgcataacgctgcggactataaatgtccagcagctccttggtcttgttctcagcccaaacttccagtgcctgaataatctcaatacaggcaccaactgctgaaatacggctgatcgcctcaacatcactgtcgaattcatcgttcttacgtctattgatgaaatacttcaccaaatcagaagcgccagcaaacacactgactgcacgccgatagtacgatacaagcctgtcagcatcattctgaaccagctcttcgcggtcttcgaattcctctcccgtcaacgggtcaatacgcttcacactcactatcgtattgctaatatccgtgtatgcgcgcttataatctccaggatgacgcctaatctcgccctcgacgttgttatagaaatcctcatctatctggcttgctgtatcataatcaatatcaatatcagatgtaatcacgtcaacgcaatcccacaggtcgaggaaatgattcggcttatcatgtcgtaccctacgcgtaataattccctcaaaacttgtcttaatatcttcactgttaacctttggaattcgttccagcgcagctgtcagctcctcctcagtctcagtaacaccttcaatatctgcaacatagaatccttcgtcctctgtattcacaacgaattctgttccaacgacagcttcctgtactgactggtgtgtcgcaggagctccatgtatggtcactggaggagtatctgcaggcaatgcctgcgttggtgccgcagtaccagttgatggctgctgatgcttcttctccagcttctgttcaatctttttcttcgcattatcgaagaaacttacatcagctggattcttcaaaatagttgtagtcgcgacagccacgttgtcttctttcagcttctgaactacgccttcgactgtcactgcgtcatactcaggaaggtagcaggcaacagtattcaattcttcaactaaatcaattcttcttgcaagcggcgtacgaatcatacgaccaatcatctgagcaatatatgtcggatctgtacgcttacgacgagaataaataacctcagcacgcggacagtcccaacctgttgatacagcatccttagcaaacaggattcgaatctctgtccgctctgctacatcttcaggactcacatagggaattttgcctgcaggtgtaacaatatcttcatgttcaccaaatacgttggcaaagcaatcggaaatgtccagccacggtaaaaccttttgtatatgtgcacacaatgaagtcagggtatcttttgtaaccttgtcttctacctgtacaaccatcaacggcgtcacgactgggagaataccgtgatccgtacaataatccttccaagccttagaagacgctgccaacttaacgcatgcctgcgttaaatcctgatgtttcgtatccgcagatttcttaggtgtgcgcagttcaatcgtatccttaatcagcccagagttacgaacggacgatacagacacatcaacagacgcctttatatcacgattcttacgtccttgcatagcagcattaaatcgctcaggggtagccgagataccgacaacgcaaggcattgacggatttactccgtcctgaccatcaattaatttggcataaatcgttttattcgtggattcctttatagcatccttgccaagtccgcgatgagcctcgtcaatgaaaagatacaaatgaatgtctggatcgctaatcgtgtctgtcagaacatcataaaatgttcttcctccttcaggagggttagccagtttaccctttgcagacaaaagctgtctgttcaggaaataaatacggcccggcatcagcttgatatggctcttcacaaaatctggcccgattgcttccatcacagtagctcccgtaagcaaatcagaagctgcttcaaatcgcttcatcgtctgttcgttcaagctcgggctatcagacaaccacaaaatcactgcatggtcatctccagcatatgtatcattgctataaaacaaaccttctgctactgctgcagcgataactgtcttaccagcacctgtcggtgccgtaagagatactgctgagacagagccatctgaagcatagcttcgctgcatagaatccattttctttagaatgtcattgactgcagacttttgaaaatcaaataattcgtatttcatcaatcaagtcctccttcgccactaatttcaaacgtccttaaataagtctcatacaatctatggacgttgacacctggaagacgtttgcacatattagaatatcttctttggtcgtcagtcacgacgaatactgtcttaatagacggagtcttcttgaccttatcgcagaacttacttgcctgattgtaatcaaacaggacgccatagaaatcagtcgtcagataactctttccgatgcgtttaataatcgggcctctgcagcctgcctgcgtccaaagaagcggcgcaatcgcgtcaaaagcttggtcaagacgaatcggccatgctgactcgtatgtaagctcacagaaaatagcatttgcattaaatccatctgctttaggcaattcgtatcccaaatcaatgtcttttgctggctttccataatctccatctagtagatttccttccacatcatacccttcaatcgaacattttgtacgaggccatgtgacgtaatgcgcaatgccatgctcttcccattttttatcaccttggcgaagtccttggtcaataaactttttttcttctaccgcggatacttcattattagtcacacaaacacaacgcctatgaccgccatcgagtgcattcaaaatattcactgcatgaagtgttgtccctgaaccagcgaaaaaatcaagaattaacgcatcaggtttttgtgcaacaaaatactttaatgtatccaccacggcataaagagattttggaaaactaaatttcccgtctccgataattgatttcaacaatgaagtcccataggcaccagcgtcataaactttgttttgccatactgtagtagcacgagtaattttcccgccagtttctacgatgatcttacttccatcttcacgttctcctcgaatttcccaacggccttccttaaactttttagcatattttgtacttacatacttgaaaatataaggttgtaaaggatagccctttgacacctgaacaaatcccttatcaaccaaatcctgaagagtttccttagtgactccccagttcatttctacgccatcttctctgataggaaatactgccgttgctccttcaattacaggagcatcttcaattttttgttcaggcgtaagataatcgccaatagctacaatgcgcatagatgtatcatcaacataaatcggataaaattgagcagttccacccttaacagtgcctcgtcttgacgcataatccgttcttcttaaataaaaccatctgatttctttttccttaccatcacccataggatgagttacatgcgctttaccaaacaacagaacataaacatattcgtcagcacgagaaaataaattatcgcgtttagcaccggaaggactaattgtaacgcttaccatttgcatctgtgcttcaggaaatgtttgctccaaaagtaggccgagacgtgcatattctttctcatcaatcgttacaatgagaacgctgtcttcaggatttagcagctgtttagcaagtttcaaacgacgttccataaatgcaagccactttgaatgcctatattgatcggagccatcaacataattattattatatttccagtcttttgcgcctgtgttatacggagggtcgatgtaaatacaatcgaccttaccaggataagcatacgacaaagcctcaagtgcatgataattctctgaattgatgaccatatgatatgggtcatctggatttccacgctctacacggtcaatttccttgagtcctggataaatgacgtcacgataactcacaagaactaccacgtcttggacagcaacagattttatctcaccatcgtgctctagtctcgctgatccgtcttgaatctcctttactacccatggaatcgaattctcatctgtttccttcgagcctctctcaggaagaatattgacagtatccccaacggcaggcttctttttataaagacgaagagcctcaggcaaattatgctcaaacacaagcccgtaagaatggttcttaacgtacttctgaatctgtcgtgcaagctcaggattcagctttgcaacttcagaaatggtctcattgatattcgccatttatacgccctccttttcattatgttcttcaatccatccgtgaataatggcagcaatcgtcgtacctttctcagcagccatcattttcaaggctttcttatcagacactgtcagcgaaagcgacagtgtcgttctcggttcatttgcagcagaaacagactgaacaacggtttgctcaatctgtttctgctccgcttcacgtttcgccatgcaaattatctcctgacattttatgtaatcacacatttaattaattatacatttattcattcgataagtccagcgcttcgcgcactgtattcaccatctcaagcgttgcttccgcgacttttccctttggagcaaattcattgaagcgggagtaggagtaaaggagattcagcaacgtttaggtcatacagacattaatacaacaatgaatatttacgctcatatgaaaccctaatatggaagaaaaggcctcccaccagttcagtaaactgatgaaagaccttctctgataagatggtttttatgaaaaaagttagcatttttcactcggtatgagcaaaagtacgagcatctatctttttttacttaaaaacccctatatatcgaggctttatgatgtttattacatcatgccgcccataccgcccatgccgcccatgtcaggcattcctgcgccaccggcgttttcttccggtttgtcagcgacaacggcttcagttgtcaggagcattgctgctacagaagctgcgttttgcagagcagaacgcgtcacttttgtcgggtcaacgatacctttttcgatcatgtttacccattcgccagttgcagcgttgaagcctacgccgattttttcgtttttcaggcgctcaacgatgacagatccttcaagacctgcattgtgtgcgatttgacggatcggctcttcaagcgcgcgaagcacgatgttgatacctgtttgcgcatcgccttcagcttccactgcagcgactttgttgtatacgttgacaagcgctgtaccaccgccggatacgataccttcttcaacagctgcgcgagttgagttgagggcgtcttcgatgcgaagtttgcgctctttcagctcagtttcagtcgcagcgccgactttgatgacagctacgccgccggcaagtttcgcaagacgctcttgtaatttttctctgtcgaattcagaagttgtttcttccacttgagcgcggatttggttgacgcgtgcagcgattttttcagtgtcgccggcgccttctacgattgttgtgttttctttcgttaccacaactttagaagcgcgtcccaattgtccgatttcagtagatttcaggtcaaggcctaagtcttctgtgattacttctccgcctgtaagaacagagatgtcttcaagcattgctttacggcggtcaccgaagccaggagctttaacggcaacagcgttgaatgtgccgcgaagtttgttgacaacgagtgtagcaagcgcttcaccttcaacatcttcagcgatcagaagcaatggtttgccttgctgtacaacttgctcaagcacaggaaggatttcttggatgtttgtgatttttttgtctgtgattaagatgtaaggattgtcaagaaccgcttccatcttatcagagtcagtcaccatgtaaggagacgcatatccgcggtcgaattgcataccttcaacaacttcaagctcagttgtgaaacctttagactcttcgattgtgatgacgccgtcgtttcctacgcgctccattgcttcagcgataaggcttccgacttcctcatcagcagcagagatcgcagcaacctgagcgatagactctttgccttcgatcggcttagaaatttcttttaagttttcgattgctacagtcacggcttgttccatacctttacgcacgccgacagggttagcccccgcagttacgtttttaaggccttcgcggatcatagcctgcgcaagtacagtcgcagtcgtcgtaccgtcaccggcaacgtcgtttgttttgctggctacttcagctacaagcttcgcacccatgttttcaaacgcatcttcaagttcaatttcttttgcgattgtcacaccgtcatttgtaattaacggagaaccgaattttttctccagaaccacgttgcgtccttttggccctaaagttacttttacagcgtcagcaagcgcatcgacaccgcgaagcatagcgcggcgtgcttcttcactaaacttaatatcttttgccatgttaacgaaacctcctcgaatttttaaaaatatttatttgcttagccgattacagctaaaatgtcgctttcacgtaagattaagtattcagtaccttcgtatttcacttcagtaccggcgtattttgagaagataatgcggtcgccctcttttacttctaaagcaacgcgctctccgctttccaacacgcgacctgaaccggctgccacgattttgccttcttgcggcttttcttttgcagaatccggtaatacgattccgctggcagttttttcttcagattctacgagttcaatgacaacgcgatcacctaatggctttaacaatgtaataacctcctcaatagtatgaatatgtaattttagcactcagctctaaagagtgctaacacaattattataataaagaatctcacttccaatttcaagtcataagaataaaaaattttcacgcttacatcattctctcttacagcgattttctccttttttcacgtctggttcacttatgttacaataagaacaaataagttgattttataggataaaggagtacatatcatttgagaaaacagtattggtatatcattttgacatatgttatcatgcagctttccgcattgatcggcattcctttaatgtacaaattcggctatgcgggcgggcaccctacgaatgcgaatctcaccatggctcaggggatttattccgtcgtaagcttttttatctgcctgattatcgttctcttgattttgagaaccgcgccgaagcagacattaagaaacgggaagaaagcatccgccggcatgtccgttctctgggcggtcgcgggaatatggctcgctttattttctcagggtatcgccggaatgattgagcagtatgtctttcacgtgaacagcggttctgaaaacacgaaagccattctcaacattattaaagccatgccgctcatgattatcgtttcttctatcgtcgggccgattcttgaagaaatcattttccggaaaatcatcttcggtgtattatatgaaaaaacgaatttctttatcgccggactgatcagttccgtcattttcggcattgtgcatcaggacctcacacacctgctgctatatacggccatgggctttacctttgcgttcttgtatgtgcagacgaaacggattattgtgccgatattcgcccatgtcatgatgaataccattgtcgtggtcatgcagctcggccccgcccaaaaatatattgaacagcatagtgaacaaatgcaattaattattggaggattgtttgtatgaggaacccaatgacttggggcttgatttatttcgcagtcggctgtatctttacgtatttggccgcaagctcgccgggaagcatgtggtctttttattccatactgctgatggttttcgccgcttataatatcagcatctcgtttaaaatgttcgctttctcatttaaagtgaagaaaaatcaaaaataaaagaaaagccatttctcatcatggagaaatggctttttttatgctgatacgtcctgatcggattcactgctgccggtctgccttttccggtacgccgcttttgagatcaggatactgatctcatataaaatgcaaagcggaatcgtaatcatcaagtgagacagcagctcaggcggcgcaatcatcgcggcgatcacgagcagcacaaaatacgcgtacttcctgatcttcgataaaaacatcggcgtgatcacgccgagtctcgttaaaaacatgatcagcaccggcatctgaaacagcagcccaaaaggaatcgtcagctgcagcagaaaatgaaagtactcggtaatcccgatcacctggttgacatcgaggtcattcgagacccgcttcataaaatcaacgaccagcggaaataaaatataataagaaaacgacacaccgccgacaaacagcacgatcgaaatcggaatatagctgagtgttactttgcgctccttctcatacagacccgggctgacaaacgcccaaatctgatagagaataatcggcgaagtcaaaatgatgccgatgataaacgcgaactgcaaaaagataaacagcggatccgtcaggttaaaagcattaagggtgagctcttttacttcatcggctttttgaagatacacaatgataggttttgccagaaaaaagccggcaataaagaaaaccgtaaaggataacgccacaatcagcaatcgtttccgaagttcggcaatatgctccacaagcgtcatttgattcactctcatacgcgtcatcctatcttactgttcttctttctttttttcctcttcttcaccggctaatcccttagtagcgttcttaaattcacgaagcgtgtcccccgccgcttttcctaattcgggaagcttcttcggaccgaaaataatcaccgccaccacaccgataaccgccaggcttccaggaccgatcatgtgcagctcctcctttcgctattcaatttcttccaaaacagaataatgcttcaagaaataaaccaatgattgaagctctacagctaaatctatatgatgaattcgaatgtgatccggcacattcaaacgggccggcgtaaagttaaggatccccttgattccgagcgacacgagccggtcggtgattgactgggcggcaaccgcaggaacggtaagaatcgccacgggttcatccttaatgtgaagctctaaatcattaagatcaaagacaggcacaccgcctacctcagttcctattttactctgattcacatcaaaagccatagatatttttgtgttattattttttgtgaaattatagtgaagaaacgccgtccctaaattcccgacaccgatcaaaatgacgttcgtcgtttcatcctgatccagtgtttttctgaaaaatgacagcaggtaatccacattatagccgtatccttttttgccgagcgccccgaaataggaaaaatcccggcggatcgtggccgaatcgacttttaccgcgtcgctcagttcagctgatgaaacgcgctgttttcctgacgcgtgtaaattctttaaaaagcgataataaagcggcagccgttttgccgtcgcctgtggaatttttgattgatccttgttcatgattggtcctccactttatactcagatgcatctcttttaaaatcaccgtttttgcctcctgtcttttccatgaggcaggtcgggccgatgaccattcctttatccagcgccttgcacatgtcataaacggtcaaagcgcagactgaagcggaagttagcgcttccatttccacacctgtactccctttcgtttttacgcttgcctgtatatgaagaacggcttcggaatccttttcctcccagccgaatgaaatgtcgacgctgcttaaagaaagcgggtggcacatcgggataatcgctgacgtctgctttgcggccataattcctgccacctgtgcgacagccagcacgtctccttttccgatctcgcggtttttgattctgctgtacacgtcatgcttcatgtgtacgctggatatcgcagcggcagtacggactgttgaagatttatcgcttatatccaccatgcgggcacggccttcttcattaaaatgagaaaatccattcatatttaaactctccttacttctgatcatacactattttctccctgatgtcttatcctataatgttccaattctgatgtattgtttgctgacagcaggttgataagctacacttaacttattataacagaggtgaaataatatgatgatcttacaaattaatcagctatccaaatcttttggcgctgatcctattttaaacaatataaagcttgaagtcagatctcgggatcgcatcgccatagtaggcagaaacggagccggcaaatcaactctccttaaaattatcgcaggtcacctttcatatgaaaagggtgaattaatcaaaccgaaagaattaacgatgggatatcttgcccagcacacaggcttggaatcccagcttaccataaaagaagaactgctgagcgtttttgatttcctgaaagcaatggaaaaagaaatgcgctctattgaagaaaagatggccacggccgcccccgcggagcttgagacgctgatgaaaacctatgacaggcttcagcaggatttcaaggataaaggcggctatcaatatgaagcggatgtccgatctatccttcacggcctcggcttcggaaaatttgacgattccgtgaaagtgcaaagtctgagcggcggtcagaaaacaagacttgcgctcggaaaactgctgctgacccagcctgatctccttattctggatgaaccgacgaaccatctcgacatcgatacgcttacatggcttgagcattatttacagggatattcaggcgccattctgatcgtttcccacgacagatactttcttgataaagtcgtcagccaagtgtacgaggtctcacggacagaaagcaaaaaatatctcggcaactacagcgcctatttagaacaaaaagccgagcagtacgagaaagacctgaagctgtatgaaaaacagcaggacgaaatcgccaaacttcaagattttgtcgaccgcaatctggccagagcttctacaacgaaaagagcccaaagcagaagaaaacagcttgaacggatggacgtcatggcaaagccgctcggggatgaaaaatcagccgccttccgttttgacattacaaaacagagcggaaacgacgtcctgcgcgtacaggatgtttccatcagctatgacggccagccgccgctcttgaaaaacctgaccttcggcattacaagaggcgaaagcgccgccctcgtcggaccgaacggaatcggcaaatcaaccttgctgaaaaccattatgaacacgctcagccccgaatccggatcgatcacgtacggttccaatgtcacaatcggctattatgatcaggagcaggctgaactgacctcgtccaaacgcgtgctggacgagctgtgggatgaatatccggacatgccggaaaaagagatcaggacatgcctcggcaacttcctgttcagcggagacgatgtcctgaaacctgtccgttctctaagcggcggtgagaaagcaagagtcgcgcttgccaagctgatgctgcaaaaagcaaactttctcatccttgatgaaccgacaaaccaccttgatctggacagtaaagaagtgctggaaaacgccctgatcgactatccgggaacactgttatttgtatcgcatgaccgctactttattaacaggatcgccacaagggtgctggagctgtctccggatcatgcagaagaatatttgggtgactatgactattacaccgagaaaaaagcccagcagctggaactggaagaaatgaagcggcaggaaaaagagcaggctcagcctgccggcaaggtcaaacaggatacgaaaagaacttacgaggaagaaaaagaatggaagaagaaagaacggcagcgcctgagacgcattgaagaaatcgaagcggccgtctcatccgccgaagagaaaatcagcgccaatgaggagctgctgtgcgaccctgacgtgtatcaggatcatgaaaaggtacagaccattcacgcggagaatgaagctctgaatcaagagctcgaaaacttattagcagaatgggaggaactctccttagaagaatagaaaaagtcaagcacctctttaaggggtgcttttttatccacagctatcctccttgtcagccatataagtaagcgttttatacacactatccacaaaattttctgactttatccactttactaacaacttacagtcccttatccagcctggatttctgaatatattcacaatcctgtggatatgttagaattatctgttaataagtaaaaaaagcctcacgttttacaacgtgagacgatcaaaagatgttaattccaaaccgggctgtccgttcatatcatatgagccccggatccccttttcaaaagcaacggttccggcagccgcaatcatcgctgcattgtccgtgcataaagaaagcggcgggatgataagctcgggatctcccgaatggctgaattcctgctgcagtgcggctctcagccctttgttagcggctacgccccctgccagcagcacttgtttaaccccgtattctttcgcggccttagaggtttttgccgtcagtacatcaatgacactctgctgaaagcttgcggcaagatcctcaggaggaatcacctcatttttttgcgaggcgttatgaagcgtgttaatcacggctgacttcaggccgctgaagctgaaattgtaagacccttcctccagccacgcacgcggaagcggaatggaatccgttcccacagcagccagcttatcaatctgcggccctcccggataaggaagccccatcgttcttgccactttgtcgtaagcttcgcctgcggcatcatccagcgtttcaccgataacctcgaatgaaccatgctctttcatataaaccaattccgtatgtccgcctgacacaaccaaagcaagcgccgggaattgaagctctcctatcagcctgtttgcataaatatgacccgcaatgtgatgaacgccgactagcggtatttgatgggcaaagcttaacgcctttgccgcattgactccgattaacagggctccgacaagtccgggtccttccgttacggcaatcgcatcaaggtcatcaaagcccatctccgcttttaaaagagcttcctcaatcacaagggtaatctgctccacatgatgtctggacgctatttcaggcacgaccccgccgaaacgtttatggctttcaatttgagaagcgacaacgtttgaaataatttcattcccgttttttacgactgaggccgctgtttcatcacagcttgtttcgattcctaatacataaatatcttgtttttcactcatgtaatgtcacccacattaataacgcatcttctccgttatctgtatagtattgttttctgattcctccggcctgaagaccgaattttttatataaggattgggcgggatgatttgagaccctgacttcgagagagagccttcttgcctttttttctctgcacaattctatcgcagagcgaaacagcgcttctcccaatgattggccccgatattccggcttaatggctatgttcgtgatctgcgcgtcatctataataatccagattccgcaataccccgccagacagccgtccttttcaatgacaaggtagtgagcatacggattttccaaaagctcatgataaaatgaatccttcgtccacggagaagtaaaggatgctgtttcaatttcataaatttgatcaatatcttccggacgcatgcttcgaatcgccgttttcgttttcatccctatcaccctatttttgagattccatccatttcgcttcagcctctgccagacgcaaataatccggaacaaggctgtggacatccgcttcctctttttctaagcctaaaaacgccagctctgacggccgcggattatgctgtgcagccgttccaatcactgcttgagatgtcagctcatgcagaatggtttcttcatgaatggctgtatcgtgccctaaaaataaaaccggagacgctttttctttcagcatgccgagccaatcagtcaaaaggacattctgatctggaagaacggattgtaatcggccgtcctgatattcataaagtcccgtatatacctgtccgcgccgggcatcaaataacgggcagatcagtccttgaaagtgccgtccgttagccgccagcacctccaggctcgagacagctgaaaccggaagcttcagcgaccatgccaatgtttttgccagcgtcacaccgattctgacacctgtgtacgatcccggtcctttcgccaccgctattttcgtaaggtcctgcggtgttatgccgcaatccttcagcaatgaattgacagcaggcatggcccgcacggaatgattcttttttaaatatgtaatatactccgccatcaccgttttgtcacgaacgagcgcggcacccagtgtgtaatttgacgtatcaattgccagtattgtcatgtttatttatctcctcacaaagcgtttcataccgtgttccgcaagccgtaaaggtaatgtcccttgcctcatcaccggctcttgtgatgacgatctgcagccgttcagcaggcagctgatcctgaattaaatgagcccattcaattaaacagacgccttgtccctcaaaatattcttcaagccctaagtcttcgctttcatcctccatacgatacacatccatatgatatagaggaagcgaaccgtcatggtattcttttataattgtaaaagtcgggctgtttaccactttcgtgattcccagtccttcggcaaaaccctttgtaaaagtcgtttttcccgcgcctaagtcgccttccagtgtcaaaatgtctcccggctttgccaaagaagcggcaagcttggctacggctttcgtttcttcggggtttttcgttctccattgtaatgtcttcaaagtgagtcacccgtcttatttaaaatgattgtatccttttttctcaaggacgatttgtctctgatcattggctgtcaaaagaacacatgcttccttccgttcagttaccgctcctatcttcgcaatcggaatgcccgattgagtgcagtaatcaagcaaagaaatccactcttgctgagaaaccgttccaaccaattcaaaatcttcaccgccaaataacacccatttcttccactcagaatctccctcaggcaaatccggatgcaccggcagaagttgttcttcaatttctatcgtaactgaacttgccccagctatttcatgcagctcactagccaatccgtcactgatatcattcagagccgcgcgctgaagcttagagcagaagcggccgacctgaactctcggaacgggccgtttatgtttttggataaaataatcagtcgtatgaaaagcagaagggagtgtttctcccaataaaagagacagtcctgctgcggacgaaccgatatcccccgtaacaaacacaacatctccgggtcttgccgagcttcgcagacaagcgcaatccttctcaacttctccgatgacagtaacggtaattacggcttgaccggaagcggagacggtatctcccccgatcaaatccatttgatatagtttcgccagttccgccattccttcatacattgcctggacgtcagctttctgccagcaagaaggaaccgctagagacaccaaataaaacttcggaatgcctcccatcgccgccacgtcactaatgttaacagcaagcgccttataaccgatatcatgaggagaggaatactctaatttaaaatggacattctccaccattgtatcaaggcagacaatttgctgcatatggggtgatgctgtataaaccgcaccatcatcaccgatccctacatcgacggaaggatgataatgcgaatgcggcgtaatactgtgaatcaaatcaaactcatccatatatctcccgtctccctttatgacgctcttgtgaaatacagctctttctagtgtatcggattatgtttcaatatccaagactttaacgatataaaagaaagcttggttagataccaagctgccagcatttaaaagaaaacacaaaaaaaacgaaaacatgatcgtttcgtttacaataaaaatggcggtccggacgggactcgaacccgcgacctcctgcgtgacaggcaggcattctaaccaactgaactaccggaccatttattttttggttgcgggggcaggatttgaacctgcgaccttcgggttatgagcccgacgagctaccgaactgctccaccccgcgatgataaaattttagaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctaccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaatcatgcgattcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcactgtgcgatttatttaaaactttgaattaacaggtacgttttgtcttgtttagttttcaaagatcattataatggagcgggtgatgagaatcgaactcacgacatcagcttggaaggctgaggttttaccactaaactacacccgcgtttgaattggcgcgcccgagaggagtcgaacccctaaccttttgatccgtagtcaaacgctctatccaattgagctacgggcgcttatcaggcgacttaactatcatactaccaatcggttatgatgtcaagtgtttttttatttcttttcgaagtctttttctcgaccttgtttattatacacgcttttgagaatttgtaaagtctttttttgaaagatcattttctcatttgtcgttttcgctttgttcatcagcgacgtttaataatataccatgcacttcaaattaggtcaacacttttacgaaacttttttctcacttgttattcccttctatataataaataaaaaagcaggattcctaggaaccccgcgtctattcagattacccgctcaccttggcttccgcgctattacgatctgttttttcataagcacggaagttttgttcaagctgttcgagcgacagacctttcgtttccggaaggaaccttttcacaaatataacggacgctatccctaacaggacaaaaatgaagaaggttgcagacaatccgatgtttgcgagcaggaccggaaaagtgaaaccaacaaggaagttcacaatccagaggcagaagacagtgacccccataccaagtccccgcaatcgaagcgggaatatctccgacagcatcagccaggtcaccggagagacagccccctgctgaaacgcaaggaaagtgactgttaatgaaagaaccacataaggaagagcaggcgatcctttcagcacgactgacagaactccgatcaaaagcagcaccgcagtcgttccgatcagccccgtcatcagcatcgggcggcggccgactttgccgagaagccatattcctacaaaagtcgcgagcaccgaaatcacaccgttagcgatattgccgattaatgcggcttttgtctcgaaaccagcatcttttaaaatttgagttccataatacataattgaattcacgccggtgagctgctgcactaccgcaattccgatcccgataaacacaatgcggcgcacccacggaacggcaagatccttaaaggcggcctgctccatctcagcttccttatgaaaggcagattcaatctcagcgagctcagacttcgctttctcttcattccttattcgccggagaacgtgcagagcatcttcttttcttcctttagaaaccagccagcgcggactttcaggaactttcagcataccgaaaaacaagaataccgccggaagggccgcgataacgagcatatagcgccaggcgtgagaggtatcaccaagcacattgccgatgacagcattacacgtgaaggcaagcagctggcctgttacaatcatcaattcattttgggtaaccattctccctcggctttccgccggcgacatttcagccaaatacgccggaacggttacggatgctcccccgacggcaagccccagcagaaaacgggagatgaccataacagatacgttaggcgccagtgtacatccaagcgtcgccgcaaagaacaaaacggcaaggataaggatatttttacgtctgccgttatagtccgacaatctccctccgaaaactgctccgatcgcagcccccaagagcagggagctcgccaccatcccttcagtcaaagcggtaagattaagctggtcagcttccgccataaacggcagcgccccattaattacacctgtatcgtagccgaaaagtagacccccgaacgtcgatactaaaatgatggttctcaaaaatgaatgctggctgctatttttattcatcttcaaatcctcctaatttttacatagagataatatcggaatattcagttatcaatatttgcacctataacgtctgcatacaagttctgaccgtacaaaacagttatataagaagaaaatagcctgaaagcgttatcatttatagtgattatccactctccctctcgtcaaattgttattttatagttactttgtagtgaagttataatgatattattggcatttatgttattatcataattttaaaagcgctttcagtcaataaatatttcagaaaattttataacttacctttatattacctatatgtaatcaatttatgtttttaatcaactcattttcactatatgatcaatagttaatctctttttgataaataattgattatatattaaaaacccccaatcagcagttgggggtttttgatttattcttcgtttattgtaacgatcgttcttcctctcgcttctccttttaaaagagcaggaagcgtatccggcagctcttcaagtgtaatttccttttgaataaaggcctccagatctgcaggcttgaagtcatcagctaaacgctgccatgttttctttcttgtctccatcggacagaatacggaatcgattcccaagagactgacgccgcgcaatataaacggaaagactgtagccgggagtttcgttcccgctgtcagtccgctcacagcaactgatccgccgtactgaatctggctgagaactgaagcaagcggctcacctccgaccggatcgacggccgctgcccatttttgtttttgcattggttttaacgtgccgttatacacttcgtcacggtgaatgaccgtctttgctccgaggctcttcaaatagccgctttcgtcttcttttcccgtactggcctcgacctcgtaacctaaggttgaaagaatggagacagcaaagcttccgacgccgcctgtcgctcctgtcaccagcaccttccctttttcaggagcggcatggttttcttcaagacgctggacggacaatgcggcagtgaagccggcggttccgatcgtcatggcttctttaagtgtcagaccttcaggcagcggcacgatccaatctgccggaatgcgggccatcccgctataaccgccaaagcgggaaacacctatgccgtagcttgtcgcaatgactttatccccctctttgaaacgggcgtcatctgaggaaacgacaattcctgctaaatcaattcccggcacgaaaggatacgacgttacgatcttgccgtcaggaatggcagccaagctgtctttataattcacccctgagtagcaaaccttaatcagcacttcaccctcgggaaggtcctgaaccgccagctcccgtacgctgactgaaaaccggtcttcacgttgatcgactactaacgctttaaattgatctgtcatcactacgtctccttaaaatgaattgaatggctttggaaaagcataaaataagtttgatttgttttcaaatgtcctgcctcgtgtagtatgatcaaaagtaaaaacagcgaaagagtggttacgcatcatgtctgataaacaaaacaaagataacaaaaacaacagcagcagcaatcagccattaccggacattattcataccgccgttttcaaggcgccgatacaagttgtctgggatacggtctccactgcggacggcctgtctctctggtttatgccgaatgatttcacacctcaagaagacagtgagtttcagctggaatctccgttcggtccgtctccgtgcaagctgctggatattgaagcgccgtaccgcctttctttttcgtgggatacggaaggctggatcgtttcttttgtcttaaaggaaacggaaagcggagatacggaattcactctcattcacggcggatggaaagagccggaagccgtcatcaataaagtcaatcggaaaagctccgagattcacagtacgatggatcaaggatggaacgggcttgtcaacacgaaacttcgcggggctgttgaggcttaacacagaaggacggacacgctttccgtcctttttttgatgccgatacataaaaactgactttgcaaagacactaacagaagaaccgaaaacttctttcagggggcgctgtttatgtattattacaaagaagagctgatcaatatcattaaaccggacaagccggacccggccgcggccaaggtgcttcaggaaattttaggcgggcactacggagaaatgcggacgatgatgcaatactttttccaaagctctaatttcagaggaaaagaaaaacagttccgtgacctgcttcgcggtgtatttttagaagagatcgcacacgttgagcttgtccagcatacgattaatgcgctgctcgacgaaagcggcgctgagggccccggaaatcaggcagcagatcaggcgccgcttgacgaagcagttaaacacgccaatccgcaccattttatcatcggagcgcaaagttctcttcctgtagacgccggcggcaatccgtggaacgggtcttgggtatacaaccacgggaatctgatttccgatttattggacaatgtcgtgctggaatcaaccggcgtgctgcaaaagacgcgcatttatgaaatgagttcaaatcagacgttcagagaaacactcggttttctgatcgtccgtgacaacgcccatcaaaatgcatttacaaaagcgttggaaacactgggtgtcgaatggggcaaattatttcccgtgccgaattatgatattgaaaaatacccggaatgccggaaattcgttgagatgggttatcataatactcaatttaatttcagactggatccgacacggatcggagaaattctgcagggaacgacgccgagccgaaacggcggcgaattaagtgtgtccgagcctcctaaaggtttccccgtgccggaacttcctgagcttccgaatgagcacagccccggactgaaagatatgaacttgtaacaaaaaaacgcctgtttcgggcgttttttgtttttctgaatatgaggtttgaatgtgtttaaaacggggaatataagccgggagatcttgccatacggccgttattataatgtgagcacattgctgtacatacttcgtttcgaaagttgtcctaattttccagccggccggctgggtatgtttgaatgataatgggaattatgtaaagagaacaatgtcttttctaaggaggcagcgaatgtctaagcaaggaaacttccagaaaactatgtcactttttgatcttattttaatcggcatgggagccatattcggttcggcatggctgtttgccgtcagcaacgtcgcctctaaagcgggcccatcaggcgttttttcctggctgatcggcgggggaatcatcttattgatcggcttggtttatgcggaactgggcgccgcgctgccgcggaccgggggaattatccggtatcccgtatattcacacggacacctcgtcggatatttaatttcctttgtcaccattgtggcatacacgagtcttatttctatagaagtcacggcagtccgccaatacgtggcgtattggtttcccggtttgaccgtaaaaggctccgattctccgacaattgccgggtggatattgcaatttgcgctgctctgcctgttcttcctcctcaattactggagtgtcaaaacctttgcgaaagcaaacttcattatttcgatttttaaatatgtcgtaccgattacggtaattgtggtactgatttttcattttcacccgggcaatatgaccgttcacggattcgcgccttttggcttcaccggaattcaggccgcgatttccacaggcggcgtcatgtttgcataccttgggctgcatccgattgtggctgtcgcgagtgaagtgcagaatccgaagcggaacattccgatcgcattgattgtctgtattatcgtgtctactattatttacaccgtgctgcagctcacttttatcggggcgatcccggcggataccctgaagcacggatggccggctatcgggactgaattctcccttccgttcaaagatatcgccgttttgctcggtttggggtggctggcgacattggtcattttagatgcgattttatcaccgggcggtaacggaaatatctttatgaatacgacttcacgtctcgtctatgcctgggccagaaacggaacattattcagcattttttctaaagtcaataaagaaaccgggacaccgcgtgcctccctttggctttcgttcggtctggctgttttttggacgcttccgttcccttcttggaacgctcttgtcaacgtatgctccgtcgcattgattctgtcttatgcgattgcgccgatttcttctgcggcgctgagagtcaacgcgaagaatattaacagaccgttttatttaaaagggatgagcatcatcgggccgctgtcgtttatttttacctcttatattgtatattggtccggatggcgcaccgtatcctggcttctcggttctcaaattgtcatgtttctgatctatctctgtttcagtaaatatgctcccaaagatgatgtcagcatacggcagcagctgaaatcagcatggtggatcgtcggcttttatgtcatgatgctgattttctcctatctcggctcgttcggccacggattgggcattatcagcaatccgcttgacctgattctgatcgccatcggttcgctcggtatttattactgggcaaaatatacgggactgccgaaggctatgatcgacagtgataaatgacgaatgccggaaagaagtatggtcttctttccggtatttttattttaagggatgacaaaaaagagaacatgcgataaaatgaatgacagtcattcataaaaggaggaacccctctattggcaaaacaaagctcgggaaaatacgaaaagatcctgcaagccgcgattgaagtcatttctgaaaaaggattagacaaagcatccatttcagaaatcgtcaaaaaagccggaacggcccaaggtacgttttatttatatttttcttctaaaaacgcactgatatccgcgattgcagaaaacctgctcgacactacgctggacagaataaaagggaaaacggacggttctgaagatttttggacgttgctggacattttggtagatgagacatttcacatcacccggcttcataaagatattatcgttctctgttattccggtcttgccatcgatcattcaatggagaaatgggaagccatttatcagccttattattcctggctggaaggcgtgatcaatacggccattgaacagggtgaggtccacagcggcattcatgtcagatggacggccagaacgattatcaacgttgtcgagaacgcggctgaacggttttatatcggctgtgaacaggatgtcgatctcgaagtatataaaaaagaaatattcagctttctcaaaagaagcttgcagaaatgattggcagagaccgatcatttttgaccgccgtaaaaatgactgacattcattcataactgaggtgactgtatcatgtattggctgcttgtattgatagccggactgttagaagtagtttgggcgtccgccctgaagcatgcggattcgctctttgattggattggtattttccttctgattgccgtcagctttctgatgctgatccgctcttataaaaaaattccgatggctgccgcatataccgtttttgtcggaataggcaccgtcggcacatatgtaacgggcgtcattttaggcgaatcgttttcaatcgggcaaatattctttttggctttgctgttgtccggcattttaggaatgaaggtatttacgaaagaaactgaaacaaggggtgaacattaatggcatggctgctgttatttattgccggagcggaggaagttgtagcagccgttgccatgaaacatattgacggttttaaaaaaaagtggccgctgattgtcatggtaacaggctttatgctttcattcttttgcctttccggagcgatgcaggttcttcccacaggtgtcgcgtatgcggcttggaccggcatgggaagcatcggcgtttcggccgtgggcatactttggtttaaagaaaaattcaatctgtcacaattggtgtctctagggcttatcctcatcggtgtcatcggcttaaaactgacaacgtaacggcctgagacagctttttaaataaaaaacaaaggaccctaagcgggccctttgttttttatgctgttttgatctgttccgcttttcccgctccgactccgaaaatgaagatcagaacggagactgcgatcagcatgaataacggaaccgtccagccgtgcgtgatgtcatgcagcaaaccgaatacgagcggcccgaacgcggcaagcaggtatccgaatgactgggccatgccggaaagcgccgcggcttcatgaacatgccgggtccgcaggctgaagaacatcatcgccaagctgaacgcacagcctcccgcaattccgattaaaatgacccatagcggagtgagagccgggcttccgaaaagaacgccggcaatgccgataaggaaaaataaagccgtcagtccggcgagtgcgcgctgatttttcattttagcggcagcgatcggcacgataaaagtaatcggcaggactgagaattgcattaatgaaagcatccatcccgccttacttgagctgagtccattctgctgaagaatttccggcagccaagcgatgacggtgtaaaaaataagggattgcagccccatgaacatcgtcaccttccaagcaagcggagaccgcagcagactgcttttcttctctccgtttgtcccagtcgtgcggacgggcagttcgcgtcctcgcatttgcggaatccacatgacaaacgcaatgaaagaaaggatagcccagcagccgagcgcgcctttccagcctaaccccgctgaagaggcgatcggcacgctgatgccggatgcaatcgcgccgcacagattcatagaaaccgagtagacgccggtcatgatgcctaaatttccgggaaacttatgtttaatgagactcggcagcaggacgttgcatacggcgatcgacaatcccaacaggatcgttccgaaaaagagagtgccgattccggcgatggagcgcagcagagttccggctgtcaggacaattaatgatgacagtaacacaatctcggtcccgaagcgccgggacaataaaggaacaaacggcgacagacatgcaaaggccaaaagcggcactgtcgtaatggtgccggcagccgcattggtcatgccgaggctgtcccgaattgaggaaacgagcggcccgaccgatgtcagaggcgctctgaggttggcccctatcaatatgactccgatgaccagcaatatcagttttttacgctgacttgcttgcagaatttgatgttcgtctttaattttcatgttcatcctccatgtgtattgtatctttaaatactgtgatgtattggttgacggcctccatggcctgatccggtttctgtccgataatcgcggcggcaagctgggtgtggatccgtatagcaggggtgatttccaacaggttatggactgacgcacaaagcgcctccgtcatatgctcgtatagatcagaaagcatgttgttatgggccgcctgtacaatggttttgtgcagtttaatgtcagcctcggcataccgttttcgatcttcattttgcaaggccgcttcacattcatccaagcacaccttcagtgctttcaggtcttcgtcattacgcctttccgccgccaatcgtgcagcttctctttcgagtgcgtatctgacttctaatgtttcaagcaaatttgattttttaatatggcggtaaaatgccgcgccgagaacactggatgagctgacatacgtaccgctcccctgccttgtctgaagcaggccggcatgtacgagcgcccgaatggcctcacgcaatgtgtttcggctcacatcaaattgcttcattaaatccagctcagggggaatgcgcgtcccgaccggccatttatccgattgaattaacgattcaatttgcgtcaccacttgttctacgagcgacagtctgcttgttttggatatctccatcaaaacacctctgaaatttgtaggatgattctatcattgggtaatataacataaaagaagcgaagatgtaaatcagcggcaacaaaaaaagagtgagtttttctctcactcttcggcgcttttatgaacgttttatattgactgaggtgacgacaaacttgtcatgacggtggcgggaaaatgaatattcaaagggagtgccgttgtccaaaaagcctacatgctcgacttcaagtatcgggtcatccggccggcagccgagatattgctgatccatatcatccgacttgcacgctctgatttttctgtgtgagcctgcgattttgagctggagttcccgcgtaatatgatcgtagatggaatggttgagcacctcgtcattaatgccgggtataaggctcgccggcatgtacgttttttcaagaacgtacggttcgccttcaacaattctgagcctcactacataatagacgggagtcttttcatcgatggccaaatgtgcggcgacatcttgagacggaaactgcacttcaaaccggatgaccttgctcttgatatctttgccttttaacaaattgctcaggccgagaatttcgttgctgactacgtgaacgtgctcatcctgcatggctgattgaatgataaacgtgccgtgccctctttttctgaaaagcattccttcagccgcaagtgtatcaagcgcccgcttcatcgtcatccggctgcacccgaactccgcagcgagcgtcttttcatccgggatcggctgatctatgtcatatacactgcttttaatcctctttctcatttcgttggcgattttttcgtacttattcatcggtttcctccggctgtataatgtttgatctgtatagactccttacggttatcataaatttttttccctgcttcatcaatgacgttacagccgccgatattgaaattgaaaggatttcctcaaattttctatggaatctcgctcactattatggtagaattttttgcagaaaaggacacaaccgaataatgcatacattgtataacctcaatgatatggtttgagggtgtctaccaggaaccgtaaaatcctgattacaaaaattgtcccgtacactttttgtaatcaggattttttattttctaaaaaataaaaaaaggagtatctgtacatgaatttcaaagtatttctgcttgcagcatctaccatcgcagtcggattagttgaattaattgtgggcggtattcttccgcaaatcgcttccgacttagatatatccatcgtcagcgcggggcagctgatcagcgtgtttgcgctcggttacgcggtatccggcccgctgcttttggcagtgacggcaaaggctgaacgaaagcggctttatttaatcgcactgtttattttcttcctaagtaatctggtggcttatttcagtcccaatttcgccgtacttatggtgtcacgggttctcgcttccatgagcacagggctgattgtcgtcctttctttaacgattgctcctaaaatcgtggcgcctgaatacagagcgcgggcgatcggcatcattttcatggggttcagctcggcaatcgctttaggcgtgcctgtcggtattatcatcagcaatgccttcggatggcgcgttctattcttgggaatcggcgtattatctctcgtttccatgctgattatcagcgtcttttttgaaaaaatacctgccgaaaaaatgattccgtttcgtgagcagatcaagacgatcgggaccgccaaaattgccagcgcacatcttgtcaccttgtttacattggcggggcattacacactctatgcctactttgcgccttttttggaaagaacgcttcatttgagttccgtttgggtcagtgtatgctactttttgttcggtctgtcagcggtatgcggcggcccgttcggaggctggctgtatgaccgtttaggagcatttaaaagcatcatgcttgtgaccgtttctttcgctctgatcctgtttattcttccgctgacaacggtttctttaatcattttcctgcctgcgatggtgatctggggattgctcagctggagccttgcgccggcgcagcaaagctatttaatcaaaattgcgcctgagtcttccgatattcagcaaagcttcaacacgtccgctttgcagatcggcatcgcgctcgggtcagccatcggcggcggcgtgatcggacaaaccggttctgtcacagcaacagcctggtgcggcggtttgattgtcattatcgctgtcgcgttagctgtattctctttaacgagacctgccttgaaaagaaaatccgcataaatgtgagaccgcaaaaaagccaaaggaattccttcggcttttgcggtctttttattttgcggcagcaagctcgtcttctgtcacccatttatgattggttactttttggccgccgtcagtcggtgtatagtcgaccatatagacggttgtctttttggctgaatcaataacggcttcggcgcccttcatgcctttcatatgggatgcctcgatcacggccttatcacccggttttaacgttttatcaccggcgcccttcagctcttcctgaatgacccatttatgatcttcgacgcgctttcctcccgtttccggagtgtaagatacactgtaaaccgttgtatcataagcaccttttacggttccttgcgcatttttcatgcctttcatatgagaagctaaaatcataacgtcactgccgaccttataagtcggattttctgccttctttaaacctttcggcacctcggatgaacctgagtgattcatgtcttcgtgagagtgcgtttctttgtctttcgctttttcgcttcctcctgaagattggctgttgcatccggcaagcgccagaacggggatcaggagaaacatgctgaataaaaatagtctcgctttcatttcaagaactcctttgcctttttgatttttcactttccctttcgtttcttcagtaaaacaaaaagattgcctgtcatttctcctaattcttcaactctctctttattgcctttcatcaggtgaaattgttcacaaaatgtacacattaatggagatgcagtataattcaattatcagataatagggggaactcatcatgaaaacgaaggtttttgcggtggtattgggcgctgttttaatgattgcggggttggttttggcagaagtttcgctttatatggaatacatcacaatgctcggagctatgattttttcttctatatttatgtcagagccgaaaagaaaatttcgcgtcatcaaaggggtttgacttttctattaccgccgtcttctcaggacggcggttttgttttgcatgtcactcagtctatccgcacagccgtttcttctgtgccgtcctgatataaaacaaaatgtggggctgtttgtgctttatcacctgcaaattcaatttcaagcggcagcgccctgacaaaataacgggtttccgtcattgggaataattcgaatggagtctgcccgtctattgtaagatacaatcggttttcttttaccgccaccgatgcatgtgtgtcatcctgaaatgagtaattgccggtaaatctgctgtaaatcgcaggatcgatatctgcttttttctgatctgccggacgtttcggaatcacgtatggctgatcaaataagatgtttacagccgcggcaattacagcttgttcaaattgatacgattgttccatattgctgagataaatcaatgttttattctggtcaatataccggatcatcagagttgaatagcccggccagcctccgtcgtgactgataaccttccctttttgggggctgttttgaatcatccagccaaatccgtatccgaattgctcttcttcattccaatagcccggtgtaaacgcttgatctttagactctttgccgatgatttcttccgtataaaaagcctgatcaaacagatataaatctctaatagcggagttaacggttccgtcaccttgaatgccgtcaagaaagacgacataatcagtttcctcaagttcatccggcagcacatattctccggaatgaacatcatacacatagccatatgcatagttcggaatgttttctttactcagccttctgttataaatccgcgtatcgtgcatacgaagcggatgaaatacggcttgtttcataaattcagcaaaactcatgcctgatacaatttctataataaccgctaacaccacataccccgtattactgtaaagccactccttgcccggcgggaaataagcatccggcttatgctgcttgagcatattgatcacatcttgattaacggcaattctgtcccggtcccaatgtgttaagaacaactccatatagtccggcaatcctgacgtatgatggagtaaatgccgaatggtaatgtccggataaggaaaatcaggaagccaccgctctatcatatcgtcataacgcagcttcccttgctgctctaaaatgataacgcctaaagctgtaaacggcttcgatactgaggccaattcaaagaccgattggtcattcagcatcctctttgttttcagttctgcagcgccgaatgaaccctggtataagatgcggccgttttccgctgccaatacagcgccgtttatttcatgtctttcgtctaaagtgctgaaaagctgttcaaacgcttgttttttcttatcgttcatttcacgaacctccatatacaagctgatttactcttttatacgaacggccgctttagaagtttcaatattttcccttctcgaaacacagtcagtatactgccgttcaggcagccgcggaggtttgatgaatgtcttttattcacacaatactgtgcaggcttcaaattcaacatgcttctcgtctttatttgcaccggcaatttccatagtcgaaaacatcgcgcagacgacggctttgtattcgttcatgacggtttgaatttcaatcaggaaccgttcggatgaagccgcgtattccgttacgtactctttcattttgccgataatatcatctgcctgacggctgaagccggccgcctccaagtcactctcaaactggtttttgttgatcatatgaatatgcatttttcaaggccccttcagcagcattttgtggttatatctactgtaaaggacagacttggataaacttttaataaaatatgaacaaaatatgaattggctcatcggcctgaccggcgggctttcggctgtgctccgtttcatttggactacatgaaataatgacttctttactctgttaaaaacagctcatatatgatctaataccagtaaaatgtttaggaggcggcctatgtcagcagcaggaaatcggcaaaaattttgggtcatggcgatgcttatagcggtcttcaccgtgttcgttttctctttttctgagaatcattcacaaaagaactggcacacggcggttgaccaggcgtcagtgaatgtcttcggccagcagatctttgaaaaagaccgtctggcaaaaacactcgacgcacgtgaggcagaatctcttttgactcttgtgaaacttgcaaatgcagaacatcacatcatctaaaagccattataaaaagcctgtttccctttgacagaggaaacaggctttttccatgtattattgagcatgtttttgttcaataaaccggtcgatccgggcgagaacatccttcatgtccgtacattctttaaagctttcattaatggcttgaatgccttgtttgtattttccgttatgcagcacttcttccgcggcaagctttaccttttcagcgcttacttcatctttttgcactgtatagcctgcatccaattcagtcaggcggcgcgcaaccatcggctggtctttatcatgcgggatgacgaccagcggcacttgataatgaatgccttcatttacactgttcattccgccatgcgtgacaaacacgtcggcctgctccagcacttcaagctgcggcacgtacggggcgatgataaagttttccggcgcctgtttgattttcgacagatcggctttttccccggcggcaatgactacttttccttcaaaatctgagaacgcgtctatgcacagattgaaaaacgcttccgtgtccccgagcaccgttcccattgagatataaatgactttttcattctttaatgcgtcaatcgggaagtcgacgcgcccttttctcttcggaaaactcggaccgataaataaatactcatctccgaatgtctcactttcgggctgaaaatatctgcttgtatagacgacgttcaattcacctgtgttgttcataaattgaaccatgctgtcaggggcgacaccgtatttgtctttcatctcggccaacagctcttcacattccctgtccggctgaaacggcacgcccgattccgggtggagcggcagtattttcagacggtcttcattgaacaggaaggatgctgaagaagagatgccgggaatgttgagatagtcccgcaccagctctcccgcaccgaatttatcataatagacggcgtcgaattgaatgtcctctgcaagccgctgcacaatatgtaaaatctctagtgacgttttgatatgaacctttaaaaatgcaagtatgccggacggactgccgggatcaatgggtgtcattctgagcagatcgctgtgaagatgaactttcgcccctactccttccagtctgcttttgtatttttccgttgagatataatgaacgtgatcgccccgttcgctgaaggcctttgtcatacccaaagtcgggtttacgtgtccttctgcaggaaaattgatcatcagaatatgtttcgccatttttcaatctcctttgccttttttgtgtctcttccatatccatcataaatgacgcggaaaaaatcatgcaaggaacatccgtcaggtctttatgacggttcgatgacatcggcaaaaaaaagacaaggcatttcgccttgtctatcgtgatgattcgtctgtttcttccgctctcagcacgcctttcagatgttcttcatcatgcttgagatgctccgtcatatattgcacggcttttgttttgtcgcccttttttatttcttcaaagactttccggtgctcatgcagaataacttccgcacggtcatctcctttaaaattaagaactctgcaaaaatgaatcagcacattgacatgctcaagcagcatggccagccggctgttgcggctgaaatccacaaggagccgatgaaacgactcgtttaaggaaataatctcagtctctttgacgcctttattgacggcttcttccgtctcccgcagctgtttttcaatgaggtcaatttcactctcagccgcttcatcaataaccagttcgaccgccagtgattcaagtgacattctgattttataaatctcttcaacatccttaacggacaaagaataaatgacaaagccgtttcgatcgtctgccgtcagaagcccgtccttttcaaggagccgcatggcttctctgaccggcgaccggctgactccgaaatccttggccagctgagtctcattcagccgttcacccggtttaaaaatcccgtcaaatatcatttttttcaattgggaataaaattgcagataatacgggattggcttatctaatttaaaattatccatctttcctacctcttcatacaatttaggccttattgttaccaagatcatataacagtttatctatggaagcaacattcccgagcttgtcagcatatctgaggtgccgtaatatggaagtatagttggtcgagggtattccgtaaaccgaaaacaattcattcggaggtgacggaaacatgaagacatactagattgccagcataccgggggacggtgtggggaaagaagcagttccgcaagcggaacgggtgttgaacgcgatcgccgaattacatggaggcattgcctttgagttcacttcttttccgcggagctgcgagtattacttagagcacgggactatgatgccggatgatggatgagaaacgttacagcactttgatgctttgtttttgggagcggcggggaatcaaaatctcgttcccgatcatgtttcgctgcggggactgctcatcaagatacgccgggaatttgaacaggtgattaatgtgcggccggcgaagctcctgccgggaatcacttccccccttgttaacccgaaggattttgatctgatagtcgtccgcgaaaacagtgagggcgagtacagctctgtcggcggcagaatctatcagggtgaggacgaaatcgccatacaaaatgcggtcttttcccgacggggtacggacagagtgatctgtttaggaaccggaagcgttcggctggggttttgccaaagaaatgatacaatttttttaagagatagagagagaaaattgtatgacaaatcgcagcaggggactgcaaggaaacggtaaccactcctttaaatgtggtgaaaaaagaggatatacgtacaagacaggacgattgaagacggtctaatggcatcttcacattaaaagttacatccacaaatatgtctttacacaataaagttagagaggtaaaaaatatgaaaaaaacattttacttttttttgatattatatataattatagtattattacttaattctgtatttgacttaagtaatgtattattaactgttttgtttgctatattcgttggtgcattagtgatttatagcattgcgaaacggagtaaaggtgatgagagaaaaaagtgttaaagaaggttactaaattatttatagcggggtgtattctcgctactgtgttgtctgctttcgctccaagttctgaagcagcttgtcgacggacaaatcttgggactcagtgtgataatgatgttcttcttaaaaaaagggtaaaggtttattacacaaaaaatcaggtaaaaaaagttgtttctagatataacagcatggggtctaataaagggcttattctcggttatattattgggttggtacacccttctactggtttaagtgttttaatgtatcaagtaggagctaataatatgattaagccttttaaaactgctaattctaagaaaaagggtttagagatttcttacacggttaccgtttataagtggtcaaatgcatctactaaggtatctggagtaaaatataaatatagataagactaagtaatacataatgagcaggcgatggcctgctttttttattacaggagaaatgtgcaaaatgaaaaaggaaaactgaagtggaaatcgatctgcatgtcagggagcctgtgtgatgatgcgtttctagcgtgagtcaacggcatccggattgcagggaggattaaggagttgactcactcagtcagcattcaaacaaacttgtttcaattggcggaaacacgtcacaagcgcgacgaaatcaaacggtattgttcactcgatgccgttctgggctgacatctttaaagaggtcagccgggagtacgccgggattgagacggattcccagcacatcgatgcactggcggccttcttcgtcacgcagccggaacgctttgatgtcattgtcgcttcgaatctgttcggagatgtgctgacagatatcggcgcggcgattatgggaagcatcggaatcgctcccgcagccaacatcaatgtaaacggcaaatatccttccatgtttgagcctgttcacggctccgccccggatattgtcgggaaaggaattgccaatcctataggccaaatatggacggcgaaattaatgctcgattcattcggagaagaggaactgggtcatctcctcttacaatctattgaaacggtcacaaacagcggcattctgactcctgatgtcggcggaaaacattcaacggaagatgtcacttccgctattatttctcaaatcaagaacagataatacgaaaaaaaccgcgggcaggaaaactgcacagcggtttttttcgtctcagacgggacggatcacgcagaaacaggccgattcacctgtgaagcccgcaatacggcctgattgatccttttctacagaaaaaaaccgctgtatatcacgaggagcatccagcatctgtttttccagtaatgcggctttctcttcagtcaggcctgcccgttcacaccagacggtaaattgaaatggtttcaaaaagcagacagcggattcaatccggaagccggctgtctccagaaaacggagccattctgtttttttccacgcccgaaagtggctctgatcccgtttcttttcaatgtcattataaaaatggtcatattcatccttttcaggtgcggtattgtcaatgagaagcagtctgccgcccggtttgacaacccgaaacgcttcatgaacaaaggctctgacatcgggaaaatgatgcgctgcgattctgcatgtgacgatatcgaaagcagcatcggaaaacggcatcttttcagcatcgcctttttcgaatgacacgttcgtccatccgtttccggttataaatgcttcagcggctgctaacatttcttccgtgaggtcataggcgataacagagcgtacgagaggagcgagagcgttagccgtatgtccgcctcccgtcgcgatatccagcacgtccatatgcttttcggcaccggaggctgaaacgagatacgccaaatcctctcctgcggcgtgtcctggactagtcacatatttcgcggcgtttttggcaaattgccgctgcgcctgctgtttaattgaatcctccattatactcgggcccccttttctttctgattgctgccttaatcaaaataaacgggttcgtccggatgtttgagatacgcaaacatcttttcaatctgactttctgtattgcgggcttcagatagcggcggcagttccgtttccgcaaaaaaaccggcggcgcttgtttctgttccctccctgatccggccgccgatgatctcgcatttgataaacactttgtaaacgtgggcggcggacggcggatgggaatggcatttcttatccattacagctaacagtttaacgggctttacttcgattcccgattcctcttttacttctttgacagcggtctcgcccggagaaatcccgatatcagcccatccgcccggcagcgcccatctgccgtcgcttttctctcttaccattaatatgctctgatctttaaaaactgccgctctgatatcaactttcggagtgggatagcccgtgtcaccggcgaatacgtctttgatgatccttttgtcggtgccggtatgatgcgccatgatatccacgcttatttttcttatttcttcaaatctctcaatatcatatatgtctttggaataagccagccccgcttgcgccgcggattgaagctgttttgcccattcaagccattttggctccattttttcaccgcccgttatgttaattgacgaaaccccaagagtcaggatattgcaccttgagagtaccggtgcccatgatccgtttctgctccttgttttctgtttatggaggggcgaatcctgccggaaaaacagaaaaaagccattcatttggggactgaccccataatatgagacaaacaaaaaacaccttcaagtttgaaaacggatcgttgttatccgaaattagacttggaggtgtttttctatgagggcaagagtgagttatccggttgaagtcaaacagaaggctgtagaaatgagattggcgggcgtgcctgtgaaggagatcatgcaggaattgaatataaagaataagacgcaggtgcagacatgggtcaggtggtataaagctggggacacacatcgattcgaacaacctgtcggaaagcaatattcttatggaaaaggtccagagtattcttccgaattagagaaactgcaggcagaaaatcgttatctgagacaacagaatgaagtgttaaaaaagtacaacgaattggaaaggaagctgatagcgaaacgccagtcgagcttgtagaagcattgcgcagcacaatgaccataaaggatatctgtattcatttaggtatctcacgagcatcttattatcgttggaagaagaatctgatgaaagataaccctaaataccatttagaaaaacaaatcggcacgttgtgccgagaacacaagtatcgatatggctatcggaaaatcacagccatattaaaaaagggaatgcgtatgaatcataaaacggttcagcgcattatgcagaagaatcagtggcaatgccgggttaaggtgaaaaagcgcaagaagaatgggcagccatatgccgtggccgagaatatattggatcggaactttcagtctgatcgccctctggaaaagctagtaacggatatcacatatttgccttatgggcagaaacaattgtatctttccagtatattggatttatacaatggagaagtgattgcttttacgattggcgatagacaggacacagactttgtcttacacacacttgatcagctgcccgcactgccagagaactgtgtgttacatagtgaccaaggttctgtttatacatcttatgagtatcagaaagctgttaaaacaaaaggcattaccatgagcatgtcccgcaaagggacgcccgctgataatgcctccatcgaatcgtttcattcctcactaaagtctgaaacgttctacctcgacaggttggaaagcactacgacgaccatcgtagaacaaactgtcgaaacctatatacactattataacaacattcgtattcaaacgaaactaaacaaccagccgccggtcacataccgacagctggctgcttaaaggtgttttgatccctgtctcaaaaacgggggtcagtccctttgctgaatggctttttttcattttctatttttctttcatgacgagaacgacgcctgaaacaataagagccgccccgatccagaaggttcctccgatcgtctctcccagcagcagccagccgagcaaagtcccggaaagcggctgaaagaagaaaaacagaccgccgcttgccgcattcagtaattgcaatccgcgattccaaagcatgaacgcgcaggcggttgagatcacacccagatataaaagtccgccccatatctcaggccgggcaagctgagacaaaggaatctcccgaagcgggcccgctgtaaacggggtcaggatgacaaatgcgacgcaaatggaatacgttgtgacgacaagcggtgagtaatggccgggaacccgtttcatcagcacggacatcaaagcccatgtcagcgccgcagccagaagcgagagaccgccgagctggctcgacatattgagatctccgttccccacaatgagcaatactccgatcgtcgccagccctgtcgatattccttttttcagcgttaaccgttctttcaacatcagccgggcaaatacaaccataaatgcgggagtggatgccgtaataatcgcacccatctgcgcggttgataatttcgtgccgatttcctgcgtgacgatcgaaaccgtgttgccgatcaatccgatcgcagcgatcagtaataaatcacgtttatgaactttccaggattggcgtgtaaataaactgagaatcaaaagcgaaagaagcgccaccgcatatctcagccataccagttcaagcggcggaatgaccgctaccacaacttttacaacgacatacataccgccccagatactggcggccaatgccaaataaatcgaaccgaacaatgtatttttcaatttgatgcaccctccgttatcatattaggtcacgtcatatgccctaacggagagaagcgcagtcaccttcctccattaagggcggagaagtgctgccggtacatcatgttcaaataagggcgctagaaacatatcgtttttcacctcaattgcaatctgatttttctcattatacaaggtttgttaaaagacgtaaatgaacggcggcatcggctttatggattgcggacttgcagctggattcttgtgatctgattgtcaaacccgtccgccacaacctcatcaagcatatattcttcatatgcataatcgcccatttccagcccatactcttcagtaaactgcatgatgctgcggtaagccgcttccgcttcatcccctatttggtacccgacggcataaagccctttcggcttgatatggaggtctctattctctatgccttcttctgtcttcatataaaaatgggtgtagttgtagaattcttttttcagaatctgctcccgcgcaaacagtccgccgaccggatgcccctgatcgagttcatgtacccgcatatagcggatcaattcggaaatggcggcagtatattgccgttctggcaaatggagtacgggccgtcctatcataagtgtctcttcatctaatcgctgcaatgagacggaggaaaagtctgtctccaaggcttgttcggtcagcttcaccttcgtccgaatcatcctttgcaggtgctccagctttttgattttgctttcgatttctgaagatttctcttttaaaagcgcgatgataccctcaggggttttgtctgttaagagcggtttgatctgcttcaagggcacgccgacctccttaaacagaccgatgacctggaacagttcgaattgatgataggaatagtatctgtatccgttcgcttttttgatttccggagaaagcaggccgatctcgtcataatggaacagggtttgtttttttacgtggcacagttttgcaaattcacccgttgtgaagtattttctgacgtcttcgctcataatgcctccttgactatacggtaaccatatcctttatgatgatcattgtatccgagagaaggctgattcacaaatggcttacgcaatgaaagctttaccgtctcaaaaaaagcggaagaggagtatcaagtatgacgattgaaatcagaacagtcacggaagaaaaccgtgccgatatactggcgcttcatgtaagtgaaagccagacttcatttattgaaaccgcggaagagtgcttacaagatgctgaggattgccggcattatcagccggccggtctttatgttaacggggaattggtcggctttgccatgtacggatggtttccggaatatgatgaggaaaatgaaaacggcagagtgtggcttgaccgtttttttattgatgaacgctatcagggacggggattgggcaagctgttgcttgatgccctaatccgtcatctcactcaaatatatgattgcagacggatttatttaagcctgtttgaagataatgtgcacgcattgcggctttatcaaaaattcggcttcttattcaatggagagctggactcaaacggggaaaaagtgatggtgaaagagctgtaaaccctctgtataaaagcaattcggcttcttgccaataccttaaatttgaggtaacataaagatattagacgacggtcgacggactacggtcgattattaaaacctgatacagcggagcggaacatggtgatcaggcatctaaatggaggagaagattgtgcttattatactcgttatgtttcttctcgggattattctcgggtttatcggcgccgggggagccggttttgtcattgcacttttaactatactgtttcacgtaccgattcatacggctttaggcacctcccttgccggaatggctttcacaagtttatcgggggcattcagccactaccgtgaaggcaatattcagatgaaaatcggcctcatcgtcggcgtttttgcggcattcggttcgtttttcggggcaaggcttacttcccttatccccgcagatttgctgcattacttgacggcgggcatgctgtttttatctgctctgcttattttagtccggttatttattgtaaaagaaacacaagaagattccggacggcaaagcaatctgaatatatgggtgaaagccgttgtactcggtgtcatcgcaggaatcttgtccggaacgttcgggatcggctctgcccctttcatccaaatcggcttaatgattcttttgcgcttatccatccgccagtcggtcggcaccaccatgcttgtcattatcccgcttgcggtcggcggaggactcggttatgtgacggaaggatttgtcgattatatgctgttggtcaaagtgctgatcggaacgatgtgcggcgcatatgtcggagcgaaattcaccaacctcgtgccgaaagtcattctgaaatcagccatctttttaacaccggccatcgccggtctcatgcttttattttaaactgaaacgggaggcggccgcctcccgttttgttctgttcttcatctgttttcgaagagctttttcagctttgcttccgtttcggtatgatctaccggcgtatacacactgcaacgcagatcactgttgccctgaacctgaaatgaagtcaggttaaagaccatttttcccgccttcgcgtggcggaactcaattaatacttcgggtgccgagctgacttcgctctcattccacagcgtatgaaattccgaatacgttttctccatttcttctataaactgagaataccacgtatcagctacatactggccgtaatacgttctgaaaatggcgatgaatcctttcacaaagtgctcccagttcacggctaaacttcttaattcttttctggaaaacaaaagctctatgagattccgtttttcaggaggaatttgttcaaaatctaaaaatacgtgagccgcggcctggttccatcccacgatatgacaccgcctgtccgagataatggtgggacaataacggagctcctgcaggatttttgaaagggacgggctgataaccgcttcttcctccgcagcaaacggctgcttcacgccctcctcaatggcaagggcgtataaataatttctctcatctttgttcagctgcaacgcatcggaaacggcgtccaatacggctgcggacactttaatgtctctgccctgctccagccacgtataccacgtggtgcttacgccggctaattgcgcgacctcttctcttcggagtccgggcgttcttctccttgtgcccatcggcagcccggccatctgcggagaaattttggcccgctgcgtttttaaaaactctgagagcgcctgcaatcttccttctggtatcataccgaatctctcctctcttaccctggtatttattatactaggataatcaacaacttgtaataggataattgcgagttaaaataaatacataccgaaggaggaatgaccatgaaaagagttgtgatcaccggaatgggagtgatttcacctctcggcaatgatgtgcatacattttggaaacacctgacggaaggaaaatcgggaatctctttcatcgattcgtttgatgtctccggctccaagacaaaaatagccggcaccgtccgtgattttgacgcagaagaaagatggggcagaaaagaagcgagacggcttgaccgtttcagccagtttgctttagcggcagcggaacaggcgcttgaaagctccgggattcagctcgatcagattgaccgtgaacgcctcggcgtgtacgtcggctcgggaatcggcggcatcacgactttgattgataacgttcatactttaaatgaacggggagcgcgaaaagtgagcccaagccttgtccccatgatgatctcaaatgcggccgccgctcaaatcagcatcagattaggcgcgctcggcccctcactttctcccgtcaccgcgtgttccatcggcaatacgtcgatcggggaagcattcaacgccattcggaatgatgacgcagatatcatgtttgccgggggagcggaagcggcgattacgaatttgtcattagccagcttcggcaatgcccacgcgctgtcagcgagaaacgaagaccccgccgcggcaagccggccgtttgacgcggatcgcgatggatttgtcatgagtgaaggcgcgggcatcttagtattggaatcattggatagcgcaatcggcagaaatgccccgatcctttgtgaggtgctcggctacggtgcgagctctgacgcctatcatatggtggcctcccatccggagggaacgggcgcatacctggcgatgaaaaacgctttgaaaaaggcgaatgtttcagcggaagacattgatgtcgtaagcgcccatgcgacaagcacaaaagccggagatctttctgaaacattggccatcaagacattattcggggagcttgcgtatgatattccggttacggccaacaaatcaatgctcggccacatgcttggcgcggcaggcggcgttgaggccatcgctctgacagaaagcctgagacacggcatcatcccgccgacgatcaatctgcagcaccctgattcggcatgtgatttggactatgtagcagacgggccccgccatcaatcgttaacgatcggcctttccaactcattcggctttggcgggcataattcggcgatcgtgctgaagaaatatgaataacgggcatcaaaaaaaggagtgaatcatttcactccttttttgctttctccggttttgttgttaaggcgaaaaaagcgatggaaccgataacggatgtcgtgaacataattgcccccatcgggacggccgtcgcttcattcatccccacaagcggcgacacgatggaaccgagaagaagcggaagcatgccaagcagtgcgcttgcgcttcccgcgcggtgtccctgcttttccatcgccaatgtaaaggtgcttgtcagcgtcatgccgatcgtaatcatataaataaaaattgaaatcaccagtgccgccagcggtccgtgaatgatcgtcatgacgagcagaacggcagtcgccgtcatcgctgtaatcacgccgattctcaacaggcttttttcgtgaatgattccgccgaaacgcccgatgataaagcttccggtaatgatcgccagaccgtttatgccgaataaaacactgaatacctgaggcgatactccgtaaatatcctgatacacgaaaggcgttccggagacatacgcaaagctcccgccgtgaataaaaccgaccgtcagcgcataaccgataaatgaccgatccttcagcaggcttcccattgtccgcacggaatttccgatggagctcggaatccgcttttccggcggcagggtttctgtcagcttgagcgcaatgataagaacaagcaaaaacccgataaaggttaaaaagagaaaaatcgtatgccatgatgcaaacggaagcagtaaaatcgcgcctcccgtcatcggcgccaccatcggcgcgacggcggtaatgaccatcagcagcgagaaaaatttagaaagctctcttcccgaaaacacatctctgacgattgcacgggataaaacgagtcctgccgaagcggtgaatccttgaagaaaacgggcaatcactaatgtagtaatgttcggtgcaagtgcgcaaaacagagaaaacaacgcaaataaaaaaatacatagtaataacggttttcttcttcccttcgcgtcacttaacgggccgacaacaacctgtccgattgtcagtccgatcagacatgcggttaaactgagctggacaagcgatgcgcgggcgcttaaatcttcagcgatttcagggaaactcggcagatacatatctatattgagcggccccagtatcgcaagcattccgagaagaaaagccagcgcaagccgctccttaccggtcggattatgcaacatatcgttcccacctttcctttgtcaatctctcaaaacatttgtatattgtatcataattttttctttatttttaaaagttttcaaagggcataaaaaaaccaagggctgtaacagcccttgggtccgggtcacgcggtaaaaggttttacgcgtgtttttctttaaatgcttttgcgtattgatcagccgctataatggcatccgccacgtcgtcagccgtaacgtcaaaagcagcatgaattgtttcttcttcaatcgtcgcggcttctgccactttcataatgtcctctttagatgcgtctttcaatttgatgtcttcaagtgtgacaggcagccccaagctgatataaaacgcgatataccgctcaatttcctcaagcgaacgtttttccagcgccaattgaacgagcgtgccgaatgccactttttcaccgtgggtcaagtgatggatttcaccttcaagcgcggtaaatccgttatgaatggcatgtgccgcagctaagccgccgctttcaaatcccagtccgctcagaagtgtattggcttcaaccaccgcttccaatgcgggcgtaacggctttcgctttcacagactcataagcgagacggccgtatttgaataataccgcttcacatttttccgcgatagcctctccggcgattgtcggaattccgcctgccatcgttttaccgccattggcgatgacactgcgcgcctctatccacgtcgccattgcatcggcaatccctgatgctaaaaagcgcggcggggcttccgcgacgattttcgtatcgaccagaaccagatcaggattcttatgatagaaacgatagttttcgaacgcgccttgttcagaatacacgacagacagcccgcttgtcggagcatccgttgaagcggccgtcggcacgataacggtatagccgtttatttcatctgatacggctttggccgtatcaagcgttttaccgccgccgactccgatgacaatagtcgcgcctgctttttctgcgatgccggcaattcttttcatttcttcctgggaggcttcgccgttgaaaaccgcctcttcagaagagatattgcttttctttaattcagccgtcaccttgtggcccgcgatatcccatacggttttgtccgcgatgacgacggctttttcaccaacgccctccagatgtccgccgatcgtttcaatggcgttttttccctgcacgtatttggccggactgataaaaattcgttccaatgtcatcatcccttcttcgttgtctctcattacatttctcttattgatagagcagaaatgaaaactcttctgatatcattcctcgttttaaattgatttaaacctcatatacactgcagaaaaatcaattttcacggcattgacaagatgtgaaggtgtctatataatcttcgatattgaagctgatcattctttactgaatgaacaaacgagattgtgaatgattcgtcttaaaaattatttagttctgctggataatttttgaggcgtttttgttttttatatatttttgactgcagaggaggtttgcacatgaagaacatttgcaaggatatactgatgattatggccggagcctttcttattgcggcgtccgtggaatttttcgtcatcccgaatcatttaggggacggcagcaccgtgggaatcgctctcgtgttatattatcttttccatatacctgcaagtattacgactctggttgtaaatttgatttttatcgggctggcttataaatttttaacgaaaaaaacgattttatacacgatactcggtacgggaatgacttctgtttttctcagcatcgtcagctttattccgttcggcgtgcacgatatggtgctcgggattgtattcggcgctctgctgatgggagcggggctggcattgatctttattgctgacggatctaccggcgggaccacgctgttggcgtatttattaaattacacaaagggctttaacatctccaaaagcatgttttatatggattgtgtcatcattttcgcatccgttttagcgatcggcatcaatcatatgctgtatacgtttatattcgtatatctgtgcgccaaaatcgtcgatattgtcattgagggtttccataataaaaaagctctcaccattatgtctgaccaatacgaagaaatcgccaaagccatcacctccgagtacggcaacgcggcgacgattttttacggatacggctattacggcagcaaagacaagcgcattatctatgttgtcattaaaaagaacgaattgctgaaaatcaaaaaacatgttcaaaaaattgatccgaaatcatttatcgttattcatgaagtaaaagaagctgtcggagggcaattcgggtttacaaacctgcccgccgccgcaaatgaaaaataaccgcctgcagtgtatagctgcaggctttttttattcggctcttccccgctcaaaggttttttacatctttcaatcgaagtagtaaatgaaaccttttttgatggaggaacataaaaaatgaatatcaaaactgaaaggctcgtaattcggacgtttgaaccggaagattggcaggatgtctatgcgtacacctcaaatccaaatgtcatgaaatatataccagagggtgcctttactgaagaagatgccaggaaattcgttactgaaaacagcggtgaacatgccgggaagtttcccgttttattgaaggatgagaaaacggtcattggccacattgctttttttcagtattttggcgatcatacgtatgaaatcggctgggtgtttcacccggaataccagggcaaaggatatgcttcagaggcggcgcgcgccgtgctggcattcgggtttaacaagatgaaattacaccggatcattgcgacatgtcagccggaaaacatggcttcgcaccgggtgatggaaaagatcgggatgagacgggaaggattttttaaaaaatgcatcccccatgataatgaatggtgggacgaatattattatgccgttttagaagaagagtgggaagtctccaatctggaataaaaaggcttataccctttgcttttacagataagtgtgtgctacactgtttgtaacaaatacgaagggatgatgggtggacaatgattaactaatcttattttgaccgtttgaaatcaaatatttcaaatcagaaaaaataggattagtctgcccattttctatacgatacgaaagctatgtgaaaatagcttatttgatcatgcacaggtacggctaatccttccaaatcaattgggaggatttttttggtcctccctttaaagcgagggattgacatatgaaagaaatgttaaaaataagcggcatcagttatgaaatcaacagcgttcccctttttgaacaaatcagcgcgagcgttcagcaaggtgacatcatcggcgttatcggtaaaaacggcgccggcaaatcgttattgctgcaattgatctgcaatcaaaaagcgccggcacaaggacagatccagatgatgcaagatgtgaacatatatatggtggaacaagaaacggaagcttatgattccggccatccggagcctgcggaggcagccttgttagaaaagtggaacgtgcccgcacgcgccttttcgcaattgagcggcggagaaaaattgaaagcccgtcttgccaaaggtttctcctcctcaagcagccttttgttattagatgagccgacgaaccacctcgatcagcacagtttagaaatactgctaaatcagatcaagaattacaaaggcaccattatttttgtttcgcatgatcgtgcttttatagatgcagcggcgacaaaaatctgggccatcgaaggaaagaaactcattgaacataaagggaattattcaagctatatggaggtccgaaaacagagaaggctgacacagcagcgggaatatgagaatcagcagcatatgatcagacggattgaagctcaaatgaacgagctgagcgcctggtcaaaaaaagcccacgcccaatcaacgaaaatagaaggctttaaagaataccatcgcgtcaaagcaaaacgcacggacgcccagattaaatcaaagcagaagcgtcttgaaaaagagcttgaaaaagcgaaagcagaaccggttgaagcggagtatgaagtccgtttttccattgagcaccgcaaaaaagcgggaaagcgttttttagaagtaagggatgccgcaaagtcatatgacggacgaacgcttttcaaaaacgtgaatttcactgtgatgcacggtgaaaagatcgcgattacaggcccgaacggcagcgggaaaacaacattattgaaggtcatcctcggtcaggaaaaagcacaggacggcagcatatggatatctccgtctgcaaacgtcggatatttaacgcaggaagtattcgacctcccgcttgataaaacccccgaacagcttttttacaaagaaacgttcgaagcaaggggaaatgttcaatccctcatgaagcatttaggatttaccgcagcgcaatggacggaacccatcggcaagatgagcatgggagagcgggtcaaatgcaaactgatggcgtttattctggaggagaaagatgtgctgattctggatgagccgacaaaccaccttgatctgccgtcacgcgagcagcttgaagacactttggcccgatacgacggaacgctcatcatcgtatctcatgatcgttactttgtcgaaaagacgacggacatccggcttgatatctcaaacggcagcgtccgaaaacaatggaaagaatctccctccgtcagggacgatgctgaagaactgcgattaaagcttgagaccgaacggcaggaagtcctcggaaaactcagcttcatgactccggctgataaacaatatcgtgagcttgatcaaaaattcaaagagctgacggaagaaatcaagaaattgaaatgaatgaaaaacccgtgattgtcacgggttttgttttggaaagctcacgtatcatgaagaataatttcaaactgatttgtacaacctacgttcagattaattatgagcatggttcaggggggcgaagaatggccaaacgcatcggaattacgggaaacattatggctgatcaatccggccctttcccgggttataatcgggcatatgtcaataatgattatattcagtctgtttctgaggccggcggtgtgccgtttatattgccggtgattcaagagacggcgcttttaaaggaacaggtctctcatgttgacgggatcattctgtccggcggtcaggatatagacccgctgttttacggtgaagaacctttacaggctttaagaaagacctttcctgatcgggacgcctacgagaaggagctgattctcacggcggttgctttagaaaagccgattctggccatctgccgggggatgcatatgttaaacgtcacttacgggggaactttatatcaagacctgacacacgcttcgtttgctgacattaagcatgatcaagaaaaagatccgccgctaaaaacccatcatgtttcttttgaaaaagggacacgtctccataccttgtttggcgattcagcgcgggtgaattcattccatcaccagatcataaaagagacggcgccttcgtttaaagcctcggcttatgcgaaagacggggccattgaagcaattgaacggacgggtgaattatttgtcgtcggcgtgcaatggcatcccgaaatgctgacaaaaaaacatgaagacatgaaaaagcttttttctcttttcatggatgcggtcagcacataaaaaaagcagatcataacgatctgctttttcattttattcttccggtttctccggtgttttgccttgtgtcagcttatggccttcgatatccacgttcggaatgattttatccagccacttcggcaagtaccaggccgcatgtcccatcagcttcatgacactcggaataatggtcattcttacaatgaacgcatcaaaaagtacaccgaaggtcattgccaagcccatggatttgatcgtagcttctcccgcaaagatgaatcccgcaaagacgaaaatcatgatcagtcccgccgctgttacgacaggtccgctatgtttcaatccggcatgaatggcttgtaccggattttttgttttgacatattcttctctcattctgctgacaaggaatacttgataatccatcgccagcccgaaaagaataccgattgctaaaataggcaggaaggcaagaatcgggcctttttccggaatgctcagcaagccggtgaaatgtccatcctgcaggacgaataccgataacccgagtgttgcggtcattgtcagcaaaaagccgacaacggcggcaagcggcacgagaagcgagcggaaaacaacggtcagcaatacaaacgcaaacccgacaatgagaatggcgaattccgggatcgcatcgtttaaccggtctgaaatatcaatgttcaccgcggttgacccggtgacgagcaggcggatgccgtttttgtctgatcgtttccgtatatcctgcactaactctttcgttgccttatcattcggcccggtttcaggcactgccgtaatgatggcatagtcccctttttcgttcggcatggcaggtgtgacgctcgccacattgtgcaagtccttcatttctttcacggcgtcttgaaatgcctcacttttgttccccttgaccccttttgcatcggcaacaattgtcagcttgccgttaaagccttctccgaatcctttagacaacagatcataggcgcggcgatccgggctgtctttcgctttcattcccgcatcaggcagccccagctctaaatgcatggccggcagactgatgacggctaaaagaatgatgctgaaaatgcttaacagaataggcttctttgtaacgaagcgcccccaggcattcgtgtcggcgcttttcttttctttcttcttgtatgatttcggaatcatccgttttcctgcgattgacaacaccgcaggcaccagcgttactgaagccaatacagccatcagcacactgagtgccgcagtcaatcccatggcagacatgaacggaatgccgacaacagtcaatccgcaaagcgcgacgatcacggtcagtcccgcaaaaacgacggcgctgcctgccgttcccgcggctttcgcgatcgattcatttttttgtacaccttcgcccaaaaactgacgatgcttcgtaaagataaacagcgcataatcaattccgacggccagtccgatcattccggataatgagagactgaccgaggctatcgtaaagaactgtgtcccaattaacgtcagcgcgacgcttacacctaacccgatcagggccgtgacaatcggcagccccgcgatgactaatgaaccaaacgtaatggccagaacgacgaatgccagcacaacgccgacaatttcagatacaccgccgatctcaacaccggcccccggcacatcgccgctgagctccgtctgcagacccttgtctcctgcggcggacagactgtgtttaatatgtgaaacagacgcatccgtaatgtcatccgccgcttttttgtacgtaatatcggcatatgccactgatccgtctttagaaatggttcctgtctcaaaaggacttgcaatcgaagcgactgaatgatctgttttgatcttctttaatgtctcttcaatcgcttgtttttccggttttgacgtcaatttcttcccgtcttcagctccgaaaataacccgtatgcttcctttatcgggaccctttgaaaattctttttgaatgatatccatcgccttttcagaaggtgtgtcgggaattgacatatcctcagaaaaagcaggttttaacgagatggcgatcacaatcgaagcgatcagtatcacgagccacgcactgatcatttttaatcggttgcgggcagaccatccacctaatttatataaaaaaccagacatcgaatactcctctccaatcattactttctgcctaattgtagttcacattcacataaaaaaaacgtacataggggcatgtacgtttgggcagtttttcattatatattcagtttcagaatgcctttttgcatggcaatggtgacggcttccgtccgcgaatcagcgcctaatttgttataaatcgatgttaatctcgcttttaccgtccgctctgagattcctaaatcgaaggcgatcgctttgcttttatgtccttgcgcaacggcttgcagaactatgatttccttgtccgtcagctgtgtttcattggcatttgcccgttccattttcatttcccggaaacgccgcaagatatccggctgcagaagcacttctcccctgaccgccgcatccatcgtatgaaataaggtttctgagcttgtgtctttcagcagataaccgttcgcgcctgattcaatgccttctatcatcagatgatcttcattataggtcgtcaaaataatgatcggcacatcagattgctcttttatctgtttaatggcttccagcccgctcatttccggcatgtacagatccatgagaatgacatcgggctttagttcctctgcgaggcggacggcggttttcccgttttccgcctctcccgttatggtgtaatggtcatttgtttctatcaaaagcttcagaccttctctgacgacaagatggtcatctgctattaacactttatacatgttccgcctctccttgaattggtatgatgatctcaatttgagttcccgctgatttggcgcttgttatacggcaagtgccgttcatcatattgacgcgttcttgtatcccaagcagcccgtaatgtccgctttttctcatttctgttccggcatcaaagcctttcccgtcatctttgacggttatgcggatctgtccctcttcttcttgaacggatacccagacattctttgcttctgcatgcttggcggcgtttgtcaggccttctccgatcatgtaatggcaattctccgccgtatgaacgtcaagcacatgatgcacgctgtaatctaaaaaacaagacagcccggaggcttctgtaaaatggttgatttgttcagtgatgctttcttttaagaacccgatcttttctgatgtgctgcgaaggttgtcaatggccgagcgcgcatcagccaatgtgcctttcactctgtccattgactggctgatgatgtctttcgctctgtcagtgttaccctttgaaagatgaacatgcaccgcttcaagctgcatatgcaagctgaccaatccttgagcaagcgtatcgtgcaagtctctcgccatccgctgtctttcattctgaagcgtcagctgtttcacttgccggtgagcgagctctaatttttcaagcgtcatctgtgtttttattttttcatcaacttgcgcgaaaaatgtggccgcatacgtgataatcacgatcatgatgggagcggcgataacgatgaaacgtagcagatgatgcggatgctcctggtgcagggctgttatggacattaaaatgaaaagatagagtatgagcagcgtttttcccttatccgccattccgataatctgcccgattaaaaaggcatagagaccgacgacaaccgcgatatagccgccggtcatcaagttagccgatgtatatatgataaatccctgtatgatgaaataaagaaacgtctttttcttcacccagcgatgggaatgccagtgcagcacggtaaaaatgacgatcaatatcgtgaataacagcagcaaaaaaaccgtccagctttcataaatgtactgcaaagagactgatgcggcatataccataaaaataaacgccagaccgggcacccgaagcgcaagcatatgcaatgagcgtctgtcacgggagacatagtcttcttgatgttttgtaccaaacaatctctgtccacttccttttagccgaccggcctcacgaggttttattctatttgtcatcataccataagtgcctgcttctcaccttccccttctttcctgcatgacgggtgaaagaaaaaacagcctgcgggattgttcgcaagctgcttttttgtttatatcttttttatgacctttcccgggtttcagcgggctcgtctcccgcgcggcaaaaccgcccacgcatcagaaaaatgttcatgacaccaacagccattccatgtgaacaagaggaagcgattgtgcttcctcttttttttgatgcaccgtcaggctttttctcagctttttctgataaacaaaatttgtaagactagacctcttttctcaggggaaattaactacgtatttctacaagggaggtttcagacgattatggataagcgtgaattagcggctcacgagtcgctggaattacatgaaatcattaacttcaagacgctttgtgtcgcgaaatccaagctcatgcaaggccttgtgtttgatcaggatctgaaaacgttaatggaaaaagacgttcagcaagcctctcaagaccttgctgatctgcaggcggtttatgaacgggcaacgtttcaggctcccgttcctcaaaaccggccgacttcgatcatcaattgaaaggaaggtaagcatcattgaatcatgaccatttagatccgatcaattcattacatgtccctgaacttgcggacatgacattcgcaatggattttctcatacgcgccaaagaaggcgtcagaaataccgccgttgctttaacagaaaccgcttcacctgatgtaagagctttgctgcgcaaacagctcatgcagggaatcgcgatgcatcaggagataacagacttgatggtcagcaaaaagtggtttcacccgcatgatctgagcgaacagtataaattggatcagctctctgcgaaaaataccctcatggtcggaaatatgaatctgtttcccgttgaaacaaacagaaaagggatgtttgaccgcacacctgatgaacactaacactggaggtattacagcatgaaggccgtaacgtatcaaggagtgaaaaacgtcgttgtcaaagacgtgcctgatccgaagattgaaaaacacgatgacatgattataaaagtcacaagtacggcaatttgcggatcagatttacatttaatccacggactcatcccgaatttgcaggaagactacatcatcggccatgaaccgatgggcatcgtggaagaaaccggtcccggcgtgacgaaagtcaaaaaaggcgaccgcgtcattattccttttaatatcgcctgcggagaatgcgtttattgtaaaaatcacctggaaagccaatgtgatcaatcaaatgagaacggcgatataggcgcttatttcggctattcaggaaatgccggcggctatccgggaggccaggcggagtatttgcgcgttccatttgcgaactttacccattttaaagttcccgaaacatgcgaagaaccggatgagaaactgagtgttatttccgatgcgatgacaaccggcttttggagcgttgacaatgccggcgtaaaagaaggcgatacagttatcgttctcggctgcgggcccgtgggccttttcgctcaaaaattctgctggttaaagggagcgaaacgcgtaatagccgtagactatgtcaactaccgtctccagcatgcgaaacggacgaataaagtggaactcgtgaacttcgaagaccacgaaaatacgggcagctacctgaaggaaatcaccaaaggcggcgccgacgttgtcattgacgccgtcggcatggacgggaaaatgacagaccttgagttcctcgccagcggattaaaacttcagggcggggcgatgagcgcattggtcatcgcgtcccaagcggtgcgaaaaggcggaacgatccagattacgggcgtgtacggcggcagatataacggttttcctcttggcgatatcatgcagcgaaacgtcaatatccgatcaggacaagctccggttatccattatatgccgtatatgtttgaactggtgtcaaccggcaaaattgatccgggcgatgttgtaagccatgtcattccgcttagtgaagcgaagcacggctatgagatgtttgacacgaaaacagatgattgcataaaagttgtactcaaaccttagagaacggaggctacagaaatggccagcgccttacatgaattactcgaaattcaggagatggcttcttttaagtcactttgtctgacgaaatccaaaaccatgaaagcgctcgtatccgatccgcagctgaaagaaatcatgcagcaggatgcggatacatcaacaaggcaattgcaggagtttgcctcgattttatctgatgcacagcatgaatgaggagatgaatgacgaatgaatccgattattgaatacttgacgggaataaatgcactgacagaccaaattgtcgcaatggatttattgaattcggcaaaaagcggtgtcagaaactatgcgatggcggcgacggaagccggaacgcctgaagtgaaagcgatcctcaccaggcacttagaagaagcccttgacatgcacgagcaaatctcacgctatatgatggaaaaaggctggtatcacccgtggaacacaaatgaacaagtccggctcaatttgcaaaatattgatacggcgctccgcctgcccgtcctataaatcgttttgctgctgagactgcacccctgactcaagcttcagtattttaaactgtgagctgccttttacagcgcccaggcggctctcagtttttttatgccttcttgtatatcggtttcagaaacccccgcgaaaccgagagaaactgttttttcagggagctgtttttgataggtgagagacacgggatagattttgacgccttgttcctccgccttttcaatcagctctttttcgctgaaaggcagctgaacgtcaagtaaaatccgcagcccggaattttctccgcgaatcctgacgtattgtcccagctcgcgccgcacggcctctaataataccgctctttttttccggtacagctttctcattctgttaatatgtttctgccactctccgcttttgataaattgagccagcgtcagctgactgtggcaggagacggtctgtttatataaagaagcgatttccctgcctttttcgataagcggcaaaggaagaatcatatagctgatgcgcagcgaaggaagcagagattgggaaaacgtccccatataaatgacacggtgatgctgatcaagcccctgcaatgatgggatcggctggccggtgtatcggaattcaccgtcataatcatcttctataatgaacgattgatgttccgccgcccatttcagcagctgaatccttctgtttaccggcataatcgttcctaatgtaaattgatgagaaggcgtgacatatacaagacgcggccgctcttcattcagcttccggatacagactccttcatcatcgacgggtatcggaatgatcttcatgtgattggctttaaaaatctccctcgctctcggataacccggatcttcatatccgatggatagatttgcttcaaatattttgcacagcatttgcaaaagagcagggttcccggcgccgactatcacttgttcaggacggcaattcaccccgcgcgactgatataagtactccgaaatgagcgttctcaattcaagctcgcccaaatcatccccgggccgatacagctcatgcccgtattgatctaagcttgcaaccatacttttgcgccatgctgaaaacggaaaatgagcggcatccacagtgccgtagtgaaaatcaatccattggcggtcttccttcgcctttgtttgaacaggcgaagcgcccggctttttcacatagacggcgtccgagtcataatcggcaaaccatccgcttctcggcttactgacaatatagccttcggcggcaagctgttcataggcccgctccacagtcgtctgactgatggaaagctgacttgacaaaagcctttttgaaggaagcttcagtcctttaggaagacggccctgatgcatattttccttaaaatgccgataaagctgctgataaagcggaatattcagatctctatttaaaaatggcgtgatatccatttttactccctccaaactggcattcttctttttataaaaactggccatttgtataagaccaatttcagtttatagtcattataaactttgaaaatgggtttagaaatatatattggagtgattggaatgaagaaagccgcaaacggctggattaacggatttatcggcgtgctcattttcagcggctcgcttcctgcgacccgcttggctgtagcggactttgacccggtatttctcaccgtatgccgcgccgcgatagccggtatattggcaggcgctctgctcctcatttttcaggagaaacgccctgccaaaagcgacatcatttcactaataacagtagcgctcggcgtcgtgatcggtttcccgctgcttacagccttagcgcttcagcatgtcacatccgctcatgccattgtctacatcgggcttctcccgcttgcgacggcgatcttcggcgtactgcgaggaggcgaacggcccaggccggtcttttggattttctcggctgccggcagcatcctcgtagccggatatgctctgctgcaaggaggagaatcctctccgctcggtgatacgtacatgatcgcttcgattatcgtgtgcggtctcggttatgccgaaggcgcccgcctctcccggcggcttggcaactggcaggtgatctcttgggcactcgttttatcgcttccccttatgttcatcctgtctttctgcttcatgccggactcatggtcaaacatcggcgcgcccgcactgctcagtcttgcatatgtctcaatattcagcatgctgatcggcttcgtattctggtatcgcggactcgcccagggaggcatcgccgcggtcggacagctgcagcttctgcagcctttcttcggactgttactggccgccatgattctccatgaaaaagcaggatgggaacttgcggcggtgaatgccggcgttatcgcttgcgtggcggccgcccggcagttcgcaaatcaatcagaaaagaccgaacaatgaacttgttcggccttttcattatattccgcccgtaggcagcagaagtctgtatctctttcacatgatccggctatttttcaggcaggctgaactcccttaaacgcactcatcaccagatcatgcacataggaatcattcacctcatcacctgtaataagcagacgatagaaaatcggtccgtaaatgagatcgatgcttacgtcaatatcaagattctctcttaattcacctttttgaattcccttttccagaaggcctttcgcttggaggcgtcggggctggaaaaatcgagcgcgatattcttccgccaattttgcatccagctgccccgcaccgattaattccttaataacggttccttcccggctcgtcaaaaatcttgctaaattcgtggcgtgggtcaatatatcttgcactgttgatcctgtatctggcacaggcagtctgtccgtagcggtcgaaagaaagctgtccatgataacggcagccttgtttgaccaccatttataaatcgttgccttacttactttggcacgctcagcaattttatcgactgtcaccgcgtcaaagccattttccaacaatagatcataggctgcagaaagaatcgccttatgtgttccttcatcgcgcggccgtcctcgtttactctgcacatgaatcattccttcccgaattataaacgatacgttcagtatacttaacctgtataaaaaaagaaaacagaaacctatttacaaaactgaacgtttagtatatcattttcttataataaaactaaacgtttagtttataaaataacttgagggaaatcttgatgaaacatagactcccaaagcctctgcgtaaaggagatgaatcagcaaatcatttatcaaagcatcataaaaaccacttaaaaaggagttcattcatatggctaaagaaaacaaacaaacagcagctcagggaatttcacctggtttaacccttcttctcgcaacggcatgcggtatcattgtcgctaatctttattatgcacagcccttggcaggattcattagtgcggcaatcgggctttctccaagcagcgccggattgattgtcacactgactcaaatcggatacgttgccggcttactgtttctcgtccctttgggagacattatcgaaaacaaaaaacttgtcgttgtatcgctccttctaagcgcagccgctttgacactgacagcatttgcgaagcatggaacactgtttttagccgctgcgtttttcatcggactgggatcaattgcagcccaagtgctagttccgttcgcatcataccttgcaccggacgccgcacgcggccgggttgtcggcaatgtgatgagcggcctgctgctcggtattatgctttcccgtccgatatccagtctggtcgctgatatatgggggtggaatgccatatttgctttatccgccgcgttaagtgttgtcctggcaatcgtcttatcaaaagtgcttcctgccagaaaaccaacagcaaacacaagctacaccgtcttactcggttcaatgtggaagctgctgcgcacgactccggtcttacgccgccgtgccatttatcatgcgtttgtatttggcgctttcagcttgttctggacgactgtacctttattattgtccggtcctgcttttcatttttctcaaaaggcaatcgcgctgtatgcattagcgggcattgcaggtgcagcggctgcaccgataggcggccgtctggctgatcgcggcttgacccggcttgccaccggaatcgctctcggtgctgtcatcgtttctttattactcccgctcatgattcaaagcagctctcacgtcggcatagcagttctggtggccgcagctatcctgttggatatgggtgtatctgccaatctcgtactcagtcagcgtgccattttttcgttggcacctgaatttcgcagccgattaaacggattatttatggccatcttctttctgggcggtgctataggatcatcaatcggaggatgggcatacgcctcaggcgggtggagtatcacattatggattggaatcgcttttccggtcatcgcattgctttatttcaccacggagaaataagcctttcaccaaaaataagccgtcaggaccaagctgacagctttttttggggtgtattcttctttacatccatccgaacaaaaaatcccgattcatgaaaagatgatattgattctttacgccccgctcatatagacgggcgcgtgcccgctgccgattctttcagcagcggtaaaaccatgtcataatatgttaagaaataattgcgccataagcaggtgaacacatgaagaagtatttatataaacaccttttgttagctctcgtttcgtccgtttgctttttattggtcttttatgtgggtttaaaaatgacacaggaagacacaccgccgttgtcttcttacccgttttacctttttatttatctttacatcgcagccggatatttgacggtcggccttgttttagcttgtatgactgatatcttgaagaaccgctggacattcaataaaccgtctaccattctattgaaacttatcgtttacttattcataccgtatgctatttttcattctttcttcattttaatggcgccgttgatttatgtgctgtttgagtcgttattcatcctgagaaaagcttcataacctgcaaaaacataccgcatgctgccggtatgtttttaacatgcttgtcagttgttcgcagtgatccgtttgatgttttcttccatcaagccggaaatgagctgttcgtttgtatgaggaatctgtttgagctgttgtacgaccagcccttgtcttgcagctgaatgattttgactcagctttgctttcccctctattttgctgattttgattttaaagccttttacccctttgttcatgcctgccagcactttcgcatcgacatcctctaatttgtacgggctgtcggggctttcgtatttcaatacgagatcactcatcgactgcacggtttcttcctcatccaaaagctccgtctctccgtaaacatgaaccgccacataattccatgtgggaacagcctgattcgtctcataccatttaggcgagatataacaatgaggcccttgaaaaacggctaacacgttttggccatcaatctctttccattgggggttcggcaatgcaaaatgaccgtataagcattcgttatccttactcatcatcaatggcaggtgggttgcatacggcatgcctcccgccgttgaaaacaatgctgcgaaaccatactctttgatgacatcgcacgcttcagcttcactcagctgaaatggagccggaatatacatacaaaactctcctctcgaacatggattgataaagcgctttccgctataataagatatcaactgacatttaaaaaggtacagtttcaaataaatacacatgtcagaggagaacatctgatgaaaaatatgattttcgctttcgaaagcgacaccccgaaatacaaacaaatttacgagcaatttaaaacattgattgagcagggaaatattcaggcagatgagcggctgccttcgattcgggagctggcagattccctgcgggtaagccgtaatacaacgctgatggcttatgatcttcttttagcggagggatacattcgcggagaaacacgcaaaggttattttgcaaatgaagtagaaccttctttatttcaaaaagaaaacgatgttgtccacgctgagaaaaccgaatcaactcagccggccctgattgattttcgcgccggagccgtcgatcaaaagcattttcctctgaaaacatggagaaaattatacaatcaagttttgacatcagagaaaagcttcctgtacggcgaaccgttcggcgagagagacctgcgtgaacaaattgccgcttatctcttggaatcccgcggagtgaaaacagatgcggattccattatcatcggcagcagcacgcagcagatgctgatatatctcagccggattctgaaagaggatttttcgggaatgatcgttgaagacccgggatttgacggtgccagagcggcatttcaatttcacgggctatctctggaaacgatgcctgtctatgaaaacggagctgatttttctcaattacatgcaatgaaagaaaaattaatctatgtgaccccatcccatcacagcccttacggcgtaagcatgtccattcagcagcgccaaactctgatcaattgggtgaatcatagagagggttatattcttgaggatgattatgacagtgaattccgttacacgcagcagccgtttcccgctcttgcttccattcaatcagaccgggtgatttatttagggaatttctcaaaatcctttcttccgggcatccgcataagctatatggttttgccgcagcgccttttgcaccggtataaagaacggtttattcatttcgaaagcaccgcttcttcgcttaaccagctgaccatggctgaattgatgaaggccggtgaatggacccgccatattaagcgcatgcgcattgtttacaggcgaaaaatgcagcacttgatttcatatgtaaagcagcagttcggcggtcatgtgacgatcatcggcgaccagtcgggtttgtatatattgatgagagttcacctgaactatacagaagaaacattaatcgaacgcgcttttcagtacggagtgaaggtatatcctaccgccgtttatttcgttgccggaaagcctgaaccgccgatcataaagttaggtttcgcccatctcgatacggatcagatcacacagggcgtacagcttttgagaaatgcttggctgtcatgaaagaaaaaaggcgccgaacggcgccttttgttatcttttatttcgtatttcttgtgaatttcggcagtccaaatataatggcggcgatgccgcagattccgattaaaacgggatagaaagagtatggcaggatgctgacgggtgaaatattcccgaatttcccggctgataacagctgcgcgccgtaaggaatcaatccttgtatcatacacgaaaagatatccagaatacttgccgattttctgttgtcgatgttgaatttatcagcgatattctttgcaatcggcccggctgcgataatggagatcgtattattggcagcagccagattcgtcacgctgaccagtccggcaatgccggcttcggcgccttttttcgaacggattcgtttcgtgatgaactccagtaaaaagtcgatcccgccgttttgtttcatcacgccgaccatcccgccaatcagcatggacaggatgatcagatcgctcattccggcaattccatccgtaatcgccttaaaataagagtcaagcgtcaggctgccgcccgctaatccgatgattcccgtcaaaaccaatccgccgaatatgacagccatcacattaataccgattaacgcaaaaaccaacacggcgacataaggaagcaccttaatccagttgtaagattcagcacccgtatggccggcgtggcctgccggaataaaaaataagataataacagtcacaatggcagcaggcaaaacaatcagaaagttcgttttgaatttatccatcatttgtgttttttgcgtccggactgacgcgatggtcgtatcggaaataaaagaaagattatctccaaacatagctccgccgaccacagccgcaatcggtatcgcgctggagatgccaagctcgccgctcaaaccggcgctgatcggcgcaaccgccgcaatcgttcccattgatgttcccatcgatatagaaatgaaacaagcaatgataaacagccccggcagcaaaaactgctgcggaataacgctcaaagcaagattgacagttgaatgcaccgctcccatcgcttcagccgccgaagcaaaggcacctgccaatataaaaatcattaccataatgataatatcaggatgtcccgcaccggaagcgaaccattctattttttgattgagcgatttcttccggttaaataacagcgcaaaagctgacgcaatgatcgcggcaatcaagatcggcaatttataaaaatctccggtcaccagaccagagccgacaaaaagccctacgaataagactaaaggcaataacgcccaagggttctttttattgttcatctgggtaaaccacctcttttcagcattaaagtcgctaatcacagtctaagcaacatttcacactttaaaagtctgcagtaaaaaagtcaagctgaaaaaaggataagtaatgattgataagatagaaaaagctgttttgtttccactctttagaaaataaaaaaaccaaggctcgtttcccttggtacatttcatgcggccccgcgtccgggacaccttctcttcattcagaaatacattcagctttcaatctgtttttaagtttcgcttcattttcaaggatatcttcgtaatcctcaatcttcctgtttaatcgttttatggtttcatcaatttccctctgtttctccgtcagccttttcctttcatttataaggatgttttttcggggttcgatcgtatgatcggctccttcaataaataaagcggtatattcaatcagcgcctcaatcgacagcccggcacttctcatgcattttataaattgaatccaattcacatcatcttcgtcataatcgcggatgccgctttcatcgcgttttaccggaggaatcagtcctatactttcataatacctaagcgttgcggctgataactcaacctgctttgcagcctgcgcaatcttcatatttttaccacccgtccttcatacctttcataagcgtgccattatagaatatcatttcataaaaaaataaaccaaactccttgacttaaagtccgctttaacatttaaagtaaaatcgaacagaggattcatcactttatcttggaaaggaagataaccatgtgcaataatcatccgactcgtgtattaagcgctccgcatgcaaaagctaaatttgagcggacaacgattgagagaagagcattacggccgcacgatatcctgattgatattaagtacagcgggatttgtcactcagacatccacagtgcattcgatgaatggggcggcggaatctttccgatggttcccggacacgaaattgccggagttgtggaagccgtgggtgaagaagtcaccacatttgccgtcggcgaccgtgtgggtgtcggctgttttgtagactcctgcggggaatgtgaatactgtctgaacggagacgaacaatattgcacaaaaggcgttgttcaaacttataataacctggactacgacggaaaccctacgtacggcggctacagccaaaaaatagttgtcactgacagattcgttgtccggattccggatcagctggatttggatgctgccagcccgctattgtgcgcgggcattaccacctattctccgctgaaacactggaatgccggccccggcaaaaaagtggcgattgtcggaatgggcgggctcggacatttagccgttcaattcgcgcacgctttaggcgcagaggtcaccgtcctcagccgctcaatgaacaaaaaagacgaagcgcttgaatttggagccgatcattactttgcaacaagcgatccggatacatttactgagctggccggacgatttgatcttattttaaatacagtatccgcgaaccttgacgtagatgcctacttatccctgcttcgcattgacggtacattggtaaatgtgggagcgcccgctaagccggactcatacagtgtgttctccttaatcacgggccgccgcagcattgcgggttcactcgtcggcggtattccgcagactcaggagatgcttgatttcgccgccgagcacggcattgctcctaaaattgaagtgataccggccaatcaagttgacgaagcgtacgaacgggttctccaaagcgatgtccgctaccgtttcgtcattgatatttcaactttataatcgacataaaaaaacataccaatatttgttggtatgtttttttcagttcaaattattttttatttcagcagccatccgggcaccgcttttatataaaccaattcgcctatcaattcaacaatcgtctgtgtgacgataacagcggcggctaatgaggcccaagcatccggcagagccagcgctaacggaaggactgcgagagaatttcttgtgcccgtgctgaagatcaatgctcttccttcacctgtatccagacggaacgcatatgcaataaaccgggagacaaacggcataatgagcaggaataacagatagatcggaatcacacgtataatgatgccagcatcactgatgacctttccgatttgtgtggcgacgaccgccagtaagaccagagccataaaaggaacaggcagccacgccgtccactccaacaccttttctcccgccggcttcttatcagcccacaattgtgtcatcactgccgccagcagcggtcccgctattaaacataagaatgcttccagaaacggccccgcatgaacagcccctatcacttctttcccgataaacagccacaagtataacggaagcaataccatctgaacggcgaacaaaactggcgtggaagccagtattaatctctcatttcctttgccgagctgagtaaagacgatgacgtaatcaatacaaggtgtaagcaataccaaacaaacccctgataatataggaggagattgaggaaaaatggcggttaacacccatacaacgaaaggtacagctaagaaattaccgatcaataaagccgccataaacttgaggtttgacaaggcttccctcagcttcaagaatgggatttgggcaaacatggcatacatgagaacagcgataagcggtgatatcgtccatccccagctgagtcctgaatctttcccggcgatccccgctattccgccgattacaagagtcacaccatatatccaaatttgctgtttttctaatgtctctctggttattttcattggctgacacctcttccccgcccattataccttcttttctgctgctcttgcattatggttctgccggaattaaaaaacaccaagggtctgtgacacttggtgtttttggaacgcggccgagaaaaacgggttgaaaaccgttaatccttgtaaataacccccaaaaagtatttttgacatactgttccttatcgaataaaagcattctctttcatttccaaagcatcatccagccatctcgggtgcatcggcaagagatgttcaggtaattcatggatatcaaaatatctgatttccatggcttcctcagtggactttttcaaagtaccgccgatgacgtcacattgaaaacaattggtaataaaatggctgactctgccgtcagggtatataaaggtttgtgaactcggatcagaatagacgcctatcattttagagactttcaccactaatccagtttcctcttctatttctcttataattgcttgttcaactgtttcaccaggttccacatgtcctgaaggaatgccccataaaccattatcagcacgcttcattaataaaacggaacttgattctttaatcataattccagcgactccggctttcacttgttctgtccattggaaatccggttttttacgtacttctgcctttatttcattatcgaacaagtctttcagatcgcggatcacaacatccggatttctaaaatcatgttttgcaggaaataaagtattttgttcagaaactaatacggaagttatgcctatttggtttgctccgacaatatctgtttcaggcgtatccccaatcataacgcatctctctttatcttcaaaagactcgagtactttttcaaatattgaagacgccggttttccaattataatcggctctttagcagctgctgttttaacagccgcgactatagcgcctgtcgcgggagctggtccgttagcggcaggaaatgttttatccccgtttgcagcgataaatgaagccccgcagcggatgaggtttactgccttatgcacatcctgaaatgtaatattttgatcccatccaatgacgacagcctccgcctgatcttccgtaagatcaataccggccttttgaatttcacttttaagttggtcatttcccaatatatatgccttctttattccttcactgacaaggtaatcagctgttgcccaccccgcagtaaacacttcatcaatacttgctgaaatccccagtttatgaaggcgtttcacaatcgtttctcttgtaacacaaggatcattcgttaaaaagcgaatggctttcttttcttcacggagtcgttttaaagaggccacagctcctggtaaagctttatctcctatatatatcactccgtctaaatcaaataaaaatacatcataattcttggagatcatcataacactccttaagcggttgtctcttggttaatagttgagcgatacgcaaaatgatttgtagggccttgtcctttcccgattcctaagggatgtttaatggctgctgaaatgaattcctttccagttgccactgattccggtatgctgtgctgctttgccagctctgcagttatcacagctgaaaacgtacagcctgttccatgagtatgctttgtatcaaagcggggagaaacaaattcctcgaagtcctcgtcaaagtacaaaatatcacgggcttctccgttcaggtgccccccttttacgacagcactttttgccccgtatacctccactatttctttcgccgcatcacgcatctgctgtacagtctcgattgattttccgatgattacttccgcttccggaatgttcggtgtaataacagttgtttggggtattaataatttcttcaaataatcaatggcgtccttatggagcagatgatgtccgcttttagcaatcataaccggatccatcacatacgattgaatatttgcgtcttttaacttttctgccagcaattcaataattcctatacttgcaagcataccggttttgacagcatccggttttatatcatccatgacacagtctatttgctgagatatattctgaagagacatctcctcaaaacttttcacaccaagtgtattttgtgcaacaactgatgtaataactgccattccatataccttttgttcctgaaatgtttttaaatccgcgtgaattcccgcccctccggaaggatcagtcccagcaatcgaaagcgctttataaatatccgtcaacttacactcctccttcaggcaggtttcactgctttaaaaatgacaaaaggcggatattccttttcacatttccaattattaaattgaaactctttctctatggcttttacatgctcttggtcaatatcgtttaacgttggttctgataaagttacattttcaaaacctgcatgagttaatagtttataatacattgacttcggccaatgaaaatcatttaaaattaaatctgcttgtccgggaacatggagccattcatttctttcttctccgtaagaatattctttccccggtattccattgcggaaggttgaaaattcaattccggttgaatcaggattcgtatcgagtatgacaaatgaagctcctggttttaacacacgaaaaatttcatttatgatacctttgatacgctggtcactatccgtattaataaaaacataacaggccattgcagcatcaactgagtgatctggtaagaaggaaagattatcgtgttcaattaaatgatagtccacatgaggatgttgtctttttgcctttgctatatctaacatcttccttgattcatcgactgcgatcacattgcagcctattctgtcagccagcctataagctacctttcctggaccgcatccgaaatcgagcacctttttaatctccgctttatcaaaagtacgaaaaacaaactcaaaacctaacgtttgttctaaaacgtcattataagcatcgaatttaccagcaacactgtcttctttccatgaagttttcattgaatttcctccttttgctcagttgagaaataatgaaaccacttattcctgacgaaaaattgatatataggaagtaaactttgaaatagagaatgatccatatcacgtttatatgcaatatgctggtatatactgaaaaggaaaagaatctgtttccagtaatcaggtaaatcaagcatttcaatatcgttttttgtcatagaaatttgatctttcctaagtaattcttcgtactttaagactgtttcaatggacggccagttatttccctcaggcattttcggaaattcaaattccggaatatcatggtgattttcagcttcttcaagcaccgttttcgcccattcatgatctgaatcataaatatggattgatcccgcattatgaaaatattctccgacttctacacgcagttctctggccattaattcctgcatgaaggtaaatgagaaaagatcactgatcatcccgcgaaaagcatcatttgcacgcatgacagaagacatgtataattcgccttccctcacaaaaaactgcaaaccgattgtgcaggaaacatctatattttctaaaacgaagagttccgaagcatcgaatatttgaataaatgccctttttgaatcaatatcttcttgtgtcaaaagattttttattctattccattgatttagttttgcatttccgaattcaaatattttaggcccgtacgcagtgcctgttaatgtttttttattcattgagtatgaaggcatttttttattgtaataactgataaaatctaagtcgttactccccgataaataccatagcacttcagcaaaattaaacacgatattagtttttcttgaggataaataagtgacacgttctattggattttccagagtcagatggtagttcaattgttctctgcttttttgtccgcgcggtgaattgaaaaattcagggttgtgatagatgtcatacagcgtttccgtatatgcttcatgaaaagttctctttctcattgagattccgccttatatgctgcaaaggtatttttaatgttctctaataaatcatctgtatctttatagctgatgtactcaacatccgccactgcatgtaacccttgaattaagaaagcataatccttgtccttttctagaaatagcacgatcttttttttcaaggcggaagcccatccaatttctatatgtgttccaggagaagcgggtgatccgggaaatgctgcaaaaaggtcgcaagtacttatttcatcaaaatcaattttagtgcattgaaggggtgtcatgaaatctttcccccacccttcccgcttgtgagcattatgaaccagccatccttcattctcaaaaaaggaaattaatgattccagctttcccctctcatacgcactcatcaatccagttttctcatctactaaacttttaaaaggccctgccagaaaaacttttttagtcgccacttcatatcaccctttcaaaataaataaagccactttcctctatggaaagtggcttaaatatagataagataaagaatctctctaatttttcacttccctacgctggtattaaccaaatcaggttcaaagggtcaggacgtattgtctcttctcagctattaaagctcccctagtgactttttataaatatttactttaattctatgctattccatataaatagtcaaacaatgactttcccttcaatattgcagcttacccactagttttaaaaccttccggcctcttttttcctgccaacgaataaggtcacggcaacactcgctgaactgaccaaagtccccagaacggcagcaagaattgtcaaaaagccattgggaatcagaaatccaatcggaatgagccccgcaaacgtgaggacgataaaacattgatagactccggatatgattcttacaaccaagctgccaaaaaaggacatgacgaatggcggaatgaacaaacataagatgattccgagtgagatcaataaaatcataggctcgtcaaaagaaatgacacgatcgccgggagactcttcagcagccgcgaatacagcaaatatagacatcatcagcgtaagaaaaacaagaaaaaaccttttcagcaacgggactgaccccataagatgagacaaataaaaacaccttcaagtttgaatacggatgattgttatccgaaattagacttggaggtgttttttctatggggacaagagtgagttatccggttgaagcgaaacagaaggctgtagaaatgagattggcaggcgtacctatgaaagagatcatgcaggagttgaatattaagaataagacacaggttcagacatgggttagatggtataaggctggtgatacacatcgattcgaacagcctgttggaaagcaatacacttacggaaaaggtccggagtattcttccgatttagagaaactgcaggcagagattcgttacctgagacaacagaatgaagttttaaaaaagtacaacgaattggaaaggaagttgatagcgaaacgtcagtcgaacttgtagaaatattgcacagcacaatgaccgtacaggatatctgtattcatttaggtatctctcgagcgtcttattatcgttggaagaagaatctgatgaaggatcatcccaagcgccatttggaaaaacaaatcggcacgttgtgccgagagcacaagtatcgatatggatatcgaaaaatcacagccatactaaaaaagagaatgtgtattaaccataaaacggttcaacgtattatgcagaaaaatcaatggcagtgtcgggttaaggtgaaaaagcgcaagaaggatgggcagccatatgccgtggtcgataatatattggatcggaactttcagtctgatcgtcctcttgaaaaactagtaacggacatcacatatttgccttatggacagaaacaattgtacctttccagtatattagatttatacaatggagaagtgattgcttttactattggggataagcaggacacagcctttgtcttagacacacttgatcagctaccaatgctgcctgagaactgcgtgttacatagtgaccaaggttctgtgtatacatcttacgagtatcaaaaagctgttaaaacaaaaggcattaccatgagcatgtcccgcaaagggacgcccgctgataatgcctccatcgaatcgtttcattcctcgctaaagtctgaaacgttctatcttaacagcattgatcgaactacgactgccatcgtagaacgcactgtcatagaatacattcattattataacaatattcgtattcaaaccaaactaaacaaccaatcaccgataaactatcggcaattggctgtttaaaaggtgttttgacccctgtctcaaaaacggggggcagtccccaacgttatgactcctttttttataaaaacgggtatctttttttcaatcaagataaccattttatgttatcaaatgaaataatatgaagtcaaaccgagttctgcacctgatttattggttcttatttttttgataatttccatataattgtccgcaagcagcatctatatcaatgccaaattgacttctgacggtcacgttaattcctgctgactttaattttttatagaagtttacaacttgtttctcatttacttcttcaaatctcataggtgaactaacagtcgggttatatctaatgatgtttacatggaacaagttccctctcttatatctgcttcttaaaagatttactacttcattcgcatgatcaatagaatcattaactcccggcagcataatataagcaatataaacttttcttgaggtcacacgtatatgctcatctaatgtgtccattacctccaataacgggtagcgttcattaatcggcattaacttgcttcgctgttcattaaaaggagaatgtaatgaaaacgtcaggttgacctgcggataatcctgagtgatttttttaatgcccggaataatacctatggtcgaaatagataacctgcgagggcttaaagcaaacaacttcggatttgtaagcacatgtaaagcatcaaaaacttgtacattcgctaatgcttctcccattcccataaaagaaatactgtcaattgaatgtccttttaagtgaaagtacaaaatttggtcagtcatttcatctgacgttaaattgcgttttaaaccaatatctcctgttgcacaaaatttacagccaaaatgacagccgcactgcgaggatatacaaaatgactcccaaccggctttatatttcatattaaccgtttctattttttcgtctcctgaaatttcaaataagacttttgtaacttgctcagaatgctgcacttttaaaggagcaatatttaaaattgactctccgaactcctctattaacaattttctcaaggatttaggaagaaccgttatttcattgaaatgatttattctcccttggaatacagcatttttgatttgattcattctaaaatcaggaaatttattttgcttcaggaactcttgaattcttatatacttgtttttttgttgcatgttttctcatccttccataatactcttgtttgtttgagtaaatagaagggagtgatcatctaacctttttttaaaatcaggcacaaaaaaacaccgacacaattatcggtgttacgcttaaataacatcatgcacaaataaacaaggacattatgtcattggattatcgtttatttgacatagagaaaaagcaccgataactgtttttgtatggtgatttggcttaaaaaaggacagactgctccctttgtccgccaaaatgtttccaatttttgcatttttaccatacaaaattccataaatcgttatcatcgctttcacctctttcttgtcaatattagcaataatcaccatatcataaggtttcccttatgtaaagctaaacaaatgcttacgcccccgctaatgacagtattatataacttgcttattaagcctaatccaagtacagaaagcgcgctgatcacatttttcacttatccgcgacggaacatttcttatataatgggtgaccggcagctgcctgcttgaatcccaatcttcctatagtgattttttatattcatgacagtatgatgatttgtcacttcagcaatcagatcgtttattcgatccagattaatcggtttattttctgataagctgctgaagctttctctgatttcttcaggatagacatttccggccatgcttgacaggccgttacacccgttactcagcatcttcggaaattcaacgtcccctgccgcaaacaaaataaagtgatcagggaactctgtttgtttatgacgcagaacgtctcctccttctttcagcccccttatcccgggatgccggcttattaagtctttaagcgctttctcactcagattaaaaccggtccggccggggttattataaagcacagcctctttagaggtatgactgagaagttcgtcaacgtaataaacggcttgctgctgtgtcggtcttatataaggaggaaaaccaatcagtacagaatcaatattggttttctcgatgtgtttcatcagtttgacggcatcactggttcttacggctgaaacaccgaacatcagttcaacatcttcaaattttcgctgattaacatactcaatgatctgaagacgctcatctatgctgagtgaatgctgttcaccagtcgtgccgcatatgagtaacgaatggataccgctgtttttcaaatgttcgacaatagcatcaaatccttctacatataaactttcatcttcatgaaaaggcgtagggatagcaacattaaaatttcgcatgagaatgtcctccaagtacatattcttgaatatctgcagagtatcatataacactgtctgacatttaaaaaggtacagtttcagacaactcaacatgtcagatgtaaaggctgacacacaaaaaaagcaggcaaagagagcctgcttcattgcttcggccataattgttttatccaattggttttggaaggctaaaatattcagactcatcaacatttgatggattcatttaggcacatgcccttatcaaaaacaatctgggtgcatatcctgctcctaaaagtcattcataaagggagtttagatatgtattattattattatccgtattatgtatatgattacagacagcagcctgatttaagccaggcaaatcataaaatgcgaagccatttatctgcgattcaacaaattccaatacactcatcctcctttcaacaatcaatggctgcggtagtgaaacacttgcaggctgtcagcagagcactcgctctgggatgcggtatgagttcagaattcagatttcttccagacacttggggattacgagaacttcatactgtacacgcgaaatatcttactccgttgagctatcacgtttattccgctttaggcgcagcagagcttctcgccgccggacaaggccgggctcctcattttcctcttatggttggctgcatgaattcaatacttcgtctatggtcaaacttccccgcagcgatagcagacctgagaagagcagccggtcaccaatacgcgtcatctgtagacgaggcggaaaatctcctaagaccaatggttccagccacacaacaggcattatccatcagtcaatctgcagtgagtccggctatttggcaggcttccttacgtgccgcgcagttagctcgggaagtacgtcagaatgttgcacaatcaatgagtcagggatcttcttattaattaagccaaaagattttttcggctttacacagtcacataaccggacttattcaacacaaaaaaagagcagtaaacacgtaagttactgctctcctctgtctatccgccgttcatttgttttacaatgtattcagcatcatttcctacaccttgaagcagcgctgaacctcgcctatgctgccaaggcaaaccaataaaatacaatccttccacagctgaaacaccccggtgatgtataattcggccttccttatccaaaacaccttctattttcatccaacaaagcggattcttaaaaccagttgcccaaatgatattgtttacttctaatgaagatgaatctttaaaaatcatttcattttgctttccggctatgactctttgttttaagatgatcttcttctgtcttattgcatgttttaattcatacccaaatatggggtcgcctttcttctgaatgaacttgcctaatattgatgtatgacttgcatgtaaaactcctaatttatcaaaccaccaaaagatgcttctttttccaatccataaagggaaataaaccggtttattactgcaagccaaatatgtaactctttctttggataattcaacagctatctgagccccgctattcccgccgccgactaccagtacattcccaggcgccagttgttttgaatgtttatattgtgaagaatgtaattgatgaatatgatcggctacatcccttgatattgatggaatattaggggtatgaaaaggacctgcggccatcacaagattcttcgtttgatattcttcccggtttgtttttattaagaaatagttctttaatttttggacacttattacttctgtccgtaattggatcgggatttcaaatctttcaacatattttttcagataagcagcaatttcattttttgaagggagtccatgcttgtctccttcaagctgcattccaggcaaagagctgtacattcgagaagtaaataaaaccaatgagtcataccggttgttccagctttctcccacttcatgacttttatccaaaatgataaacttttgtttcgacttctttagataatatcctactgagattcctgcctgaccggctccgattactatcgtgtcgtacatatgaatccccccctccggttttatcttaattgtcagcagacaaagtgagtccctatttccttctttaatgatgatgatggtcacgcggattctcagtttgggcctgacaaagaatcgtattgtcgtgattatgcgctgctgtttccatttgaatggttacatgtgtaatgccttatctccaagttcatgttcaattttgcgtaaaatactttcactttcagaaatggtcagttgatcgttaacaactgcgtggcaggaaagagcattcaatccgcttgtgatagaccatatgtgcaaatcatgaatgctttgaattccttctgtctcttcaattgtatgaatgatgtcagtgacatcgatatttcccggagttccttccattaatacgtgaatggagtctttcgtcacatggtaaccgcttctcagaacaagaatagccacaatgacactggccactggatctgcccagctccacccgaagaagatgataaggatcgcagccagtatggcacctacagatccgagcatgtcacttatcacatgtaagtaagcccctcttatgttcaggttattctttgtatctccgccgttcagcataatccaagcgaccaatatatttacagctaacccgatgatactaatcgtcagcataccggttgttgctacctccggcggatgagagaaacgtttgattgcttcataaatgatataaagggaaatcaatattaatgcaacaccgtttatcacagctgcgagaatctcaaatcgtttgtagccgaatgtcttatgatgacttgcctttttttcggccaatttaaaagcaatcagagcaaccattaatgagatcgagtcactcagcatatggcctgcatctgacaaaagcgctaaactattggttaaaaatccgcctatcgcttctattatcatataacctgtaatcatgataaaagagatcaataaaaccttcttattggatccgccagcgtgattgtgattgtgacccataaaaatctcctccttatctcatacactgcatttattatttcttttctgttatgaagcattctaacatggacaaaaaaataaccttatatgattatgtgctcatatatgaatatataggttctttactgaaatgtcaaaatcttttcaatgaaaatgtccaatactttatattgctcttgatcaatgattgctatgaagccgcggattacagtaattactttaggcgcagacaatttagaaaaatcgcttcacttctatcgagatggcttgggtctgcctacagagggaatagtcggtacagaatttgaacatggcgcagttgccttttttgacttacaaacaggactgaaacttgccatttggaaccgcaaagacatcgcacatgaaacaaacgttacgttaactgcgccaagccctgcagaatttacatgaggacataatgttggcagtaaagctgaagccgataaagtcatggaacaggcaaaacaggcaggagcaacgataactgatcccgctcatgatactttttggggcggatactccggtcacttccaagaccccgatggacacttatgggaaatcgtttggaatccgcactgggatataagtgaataaccacatttcagaaatgaaaacatcaataaaaacacacctaaatgttctggtgtgctccaataatgatgtttagaatgcaaacgcagcattttatttgtttcccaaaacgatcaaactatttatacgatggcgggatgctttgcggaaaacggaatacattttcgggatcgtatttcgcctttattctttgaagccttgcaaagtttgagccataatatgcttttccgaagttctcgatattttgatccggaacattcacatatgaacctgttacatatggtttcatcagctgacgcactctttcaactgatgcaagattcgaagcttcttgtgatttatttttccaactggccgtccattccgtataaaacaacggacggcgccaatagaaggctgtttcactgcttggtactctgcttatcgcgccgccccaattgataaaaaagaaattggtttctgtcccagtcgctttttctaaaaattgtctcattactgcaataggttcttccggccaaagattgagcgcccacgccgaggagaatttaacactctgatcagatctgccgggaatcggttcgtcaggatctaagaaatctatacaatccgggtagtatagtgttttgattactgtttgtgccggcgttccggcatttaataaaggttttaataattgaaccagctctggttttgaaccgaggaacaatccttccacatggcacaagccatttactttgctgtaaatctcaaggtagcatcctaatcgttcgtctgtaaacggcgcccatttttgccacgctttaaataccgtttctaactgttcccacggccaaatgatattaaagacggttgcggttttaggggcacggtgaactttgaatgtatattgggtgttatatccgaaattgcctcccccgccgcctctggaagcccacagtaaatcttcattgcgggattgatttgcttgaataatcctgcctttggcatctaccattttcagtgcgagaaggttatcgcttatcaggccgatcgatcgggaaagcactccaaatccgcctcccattgtgattcctccgattccgacggttggactgtctccgaacggggccataaaaccttcccgagctaaaccttttacaagcgggccgacgtgaatgccggtttgaacggttgctaccgcgtttttttcatctaagaaaactttattcatgtcactcacatcaataacaattccatcacttaccgtggaaagatttttatccagagcatggcggccgcttctgacacgcataggcacattcttctcacgagcccatttaatagcattacttatatcgtatgaattttgtgcaaaaacaaagacaagcggacagacatcaacataagggttccaattcttaaccgcctgtgtatagccggggtcccctttgaagatgacgcgtcctgttaactgtgctgatcccatctatttcactcccaataagcatttgattccgataccagtatatgtaggaattggacaaattcttagacagatgttctgcaaacttaaaaatagatacatatacgcgaagatgatataaaaacaaaaaaaaagacaagagcggcaagctgccgaaactcttgtctctcctgccttttttatcatgataggcacttacatttattggcgtgatatcccgaccaaactatggaagtccatagaaaattatgtttgccctgccatgcgtggttctgctgagacaccggctgagcaatctttctgcttgatcccccgacaaagaatcttattctttatcgtttttgcacccctgtacggttaaaatcaatacacattgaatcttatcttttacatgatgaaaagatcttattttttcttcttgtgcttacgtttgcaatcctgttttttctctttcttatgacgttttttacatttcgctttggctgctaattttgccgcttctacctttgcttctgctgctgcttttgctgcttctgctgctctggctcttgcttcttccgctcttgctattgcctcttccgctctggctctcgcttctgcttctcttgctgcttccgctcttgctgcgtcgtccgccatatcaaaatcatggccaaggtcacaggcttcgttgtatggctttttcttctgaacgtactgttgatcttcaccttcgttataatacattacgccactccttctctcatcttttaatctttacatactatgtaaagaaataactgcagcttggactggtattttgatgaaccggcacattttaggataattttcatttatcgatacaacagattctggatacttgatgaaacttaaatgtttatgataagcagcgtaaaaagggagactacgaaaaaaccaagggttaaacccttggtttttttgtgaaaatgataaaaaggatgctgcgcgctgcagcatccttctgtaccaactttttgttgaacgattggaaagtgttttttggcttttagtttgcttgctgtgtttgttttactggttctttgctaaaaagtccgacaatgttccacaagataattgcagcagctatgattacacgagtcgtactgacttcttggttagtaaacaatttatagccatatattgaccccaatgctgctatacaaaaaatattgaaccatttactccaacgcaattagaaaactccttataaaatgattacatttcaaaacaatgtattataatattaacaaaatttttcaataatttaccttaaatcattcttaattggttttcctgatcattttctctaatcgtcttcgatctttcggatttttgatcatttttttgttacaggctagacccagacatcattttcagctgtttgatcagttatttcctgcccggtattcacaacacctttaggttctacaagcaaaatgttacactctgattctgcataaggtttatgttcaacatttttcggaatgacaaacatttcaccttcatttaatgttacttctccatcacgaaattcaatgattaaattaccctcaatgacaatgaagacttcatctgtttcgtcatgcttatgccaaacaaaatccccttgtaccttaacaagtttaaattgatagtcattcatttcagcgattacttttggagaccattgatcttggaacgcagctaatttctcttgaaaattaatcggtttatattccattctttccgctttccttgtaaaactctatcatttaactagtcccaaattaaaggcctgtccacttcagcagttctgagatagtctaaaagctgaccggtatgtacggactcatggtaagcgattcttaataacatgtctcctagttcgcgaatatatccaacatcagacctgtcaatctttatatttgttaaatctgtttcgtttaacgatttgatgaatgtcaaaaactcggcccgatacggttttgcaaattctaattcttcgcttacagtggtaaacatttttgattcataaggattaatagtttcctctgaaaactcactcatatttttcattaaaatttgatgataaagaaattctgcttctaatacatgtcttatcatttccttacacgacatggcttcggaatccgggcgccagtccattttttcctcaggtatagctgcccataacttgatgcttcgccgtcttacctcttcaaaatgtaaaataataaggtcaattgtattcaagtgttttcccccttttatttttataacctattctccttctttccaggaataccttcatgagctgcctcaaaaaattaaagatatattcctttcgcctctaaataaatagtcccatccacatcattgacagacgcggtgttaaaaatggtgagaaacaactcgctagattgataaatcgaacaattttaagataaagagatattcattcatccatacaatagactctggctgaacatatactgaatgatagttttcatcagaaaggagaaatcagctttggcaaaatatcggatcatgacctttgacgggggcggaaccttaggtgctttaagtttacagctattgaacagactggctgaagaaaatccagaattaataagtcgaacccacgtatttgcgggaaattcaatcggttcatttactgcccttgcattagcaagcggaagatctccgagggaaacacttcagtattttgaggatgaaatcctgcccgcattcagcacttcccggccgggcggacctgttttcaatcaacaattaccatattccggttttattaaagcggtacgaaactttttcccgccaggccttcgccttaaagatctaagaaaacgaattgttgtcccttcattcaaattatactccccggcactggatcgttggacgcccgtattatttcacaactttcccggctctccctatttaaatgagaaagtgagtgatgtcatactgcggagcagcggtgctcccgcgacgcagcgcgcctatcaaaactacgtggacggatatgtagtggcaacgaaccccagtacggccagtatcgcgtttgcggttggtaaagccaacgtgccattggatcaaattgcggcgctatccatcggtacaggtgaagccccgactcggttaagaagagatacgaggggatggggaatggtgagtgcggataacatacgtcccgaaaacctgaagaaccttcctccaaattggggagtccttttggacaggtcgcctaatgaacctttactgccatttcttcagatgatctccggcggaaatggctactatgaatccatggtcagcgcgaatctgctgggagatcgctttttccggttagatccgcggattcctaacttctccaaaacagacccttccgtggttcccgctgtcattgaaattgcgaacaaaaccaacttacagcctgtgaatacatttatagagaaaaactggaacgacagccattaactaagttagaagtttataataattcaatgaacaaaaaataccaagggactcaaaacccttggtattattaatgcggccgagagggtttggaccttcacggggtatttatacgctgggcattcgataaagtgaaatcttattaccgcccggcatttcaaacactgaagttaagcattacaaccaacaatcgggccatttaattgaataggactactcagaagtcgcttccattacgtaagaaaagcgactttttagatttgattttcaagttcctttgacaaattttgaaaagaccattgactattcagttgaactgtattaagtttaactatatagtcagactgaatagaggatgaggatatgaaacataaattattaccgctgtctgaaaccatgcattatattttattagctctgcgggagccgcttcatggctatgctgccatgcagaagatcgaaaagatgagtaacggaactgttattttagcagccggcacattatacggcgcgattgaaaacttgaataagcatggctggattgaacctgttggagaatcgggccggagaaaagtttatatgataactgcggaaggaagcgccattttgaaaatggaacaaaacagattacttcatattttatccctgcacgaaggaagtgaatcgaatgaagaaatgtaagatgttttttgatattgaaaaagaggagcaatggctgaacgagcacctacaaaaaggctatcactgtacaaatatcagcggattaggaatatacactttcgaaaaaaccgacaaaaaatatgtaatgcgactggattatcaagattatttatcaaagaaaaagttcaaagactacaaagagatctatgaagacttcggctggagttatataaacagcccatggcttagcggaactcgatattggcaaaaagaagatgatgatcaaaatgaaatcttctcggatcgccaatcaaagagtaattattataaaagactaatgagtttttcatcttgttttgggttactgtgcttgttttattcttatttgatttacaaggattcaggtttgtatttaactgaaggtctgtggagtatggaaagcgcaatgttttggaaagcatttttatttgaaactccatttgcccttttgaggtcgcttcccgcccttatggctgttctatttggctgcagtttctataaagcgtatcgaaagtattcaatgttaaaagaacaataacgcgggggaagttacattcaaagaagtaatcgaggatcatgtatttgccgaatccgggcgctttaacggaaaaaaagcgccctgaatttgctgataaatcagacggcttattttgttaataatacatacttatttacaatggcttgagcgagacaagctgatgaatcaacaaaggtaagtccgcttcttttttgatccgtgaccgtatttaaatccgtacatgcaatgataaccgtatcaaccttttctgctaattcacggtgtaattcatcatataatgtactagccttatcgatttgaccttgtttaatcttttctattatgtgatcgacatagatttgccaactatcttgatgtaaaaaatcataaccttctctgtttaacgcttcttgaaatattccagattgaaccgtaggaacggtggctaaaagagctgctttttttgagcctttaggtatttttttatggtttcatcaaccatgtttagtaaagggactgaaatcgatttttttatttgattaaaatagatatgtgcggtattacatgggatggcaataaaatcaacacccgttttttcaagctttacagccccctcaataattgccttttccatgtccgtatgattgagaggtttattcatgtagaaaggtgtcggacaggaataatcatcatatgaggaaaatccatgtcatgtattgctccatatattttttggcactcgtctactaccttatctacaaatggcccagtagattttggccccattccagccagtattccaatcataattgtcctcctctgtaaaaatgtgtacgaatacgatcacgatgagttattcttgtgtttctcatctgaatctgctctcatttctttttggctgtcttctcctattttatcatttcattaatcgaattatcatatctaattccgccgcacgcagaagaatggcagatacactaaggttatgaaagcttgttttcattacactctctatcctccactttcatcatttctatatgttttcatgaattatggttaaaaatcggtgattaaattgtgcccatatagattagtaaagtgtcattgatgtcaaggcatgaactcctaaaggagatttaataactcattttcaacgaaaaactgatctctgttaattagtcgagattccaagatatacacggaccaattgaattgatctttccttttttgggaatcccacaggttccctcttgttttgatgttgttttttaaaaaaagttattgacaccaataaatgaccatgttatcattaaaaatttgatatctcactccatatatgataaccttaagttaagttcccatatatggaggtggattatatgtttcaaattggcgataacattgtttatccaatgcacggagcaggtacaattgaagccatagaagaaaaacaattcttagaggaaaaacaacagtattatgtcataagaatgtcaatcagtaatatgacagttatgattccaacgcgtaaaatattgagttcaaatatacggccagttactgatatacgtgcattaaaacacattatacacatttttcagcatggagaatcagataagttactgccgtggaagcaaaggtatgtagtaaacacgaacaaaataaaaacgggtgaaatacaagaaggcgttgaagttgtacgtgatttaatgcgaatgaagaaagaaaaagcacttaattcaagcgaaaaaaaaatgttggataatgcatatgaatttttgattagtgaactggaagtcattaaaggaatcactgaaaaacaaataaaaagtttctgctaaggttaattttaaataatgttttgcattccaaaaagcacccgcgagttttcggaatattacgattaaaatatttcaaagacgcttaacttcttcaacttacttttagaacattaacctcttttattattcctacaatctaatctgtttttattattaaaaatttcttcaacgaacatttgatgttttatcaaaaaactcgatgaaatagtcacttgatttttgtaatcctgattcacactggcacggacaaggagccgtaaggatggaagagaggcagggctttcattgttttaggtctaagtgattatttccagaagaaaaaacaaccactcccctctttatctttaaaatttcttacatctgcttccacagtgaatagcagttggttatcttcttttcataaaagagatatgcgaattgtaacaaagaataacatacagttatcttgagaacataaaaacaaatcatttatatatattccacatatcgtcaatccggtatgttatactgtaaacaatcctttgaggttttaaacctttttcttaccttgtagcaactgtccctactcgaacgttgagtagggtttttttattcactatgatacagagaacataaaaaaacaggccctatataaagagcctgtttgtataaacgattgaagattaagcagttttttgaacgttagcagcttgagctccgcgagcaccttgctcaacgtcaaacgttactttttgaccttcgtctaaagatttgaatccgtcactttggattgcagaaaagtgtacgaatacatcgtctccattttcacgttcgataaatccaaaacctttttctgcattaaaccatttaactgtaccttgttccatttttgttgcctcctagtgtgttacacattgtattactatccttgcccaaagtatcatcaagacgaaaagtcgatattcatactatcctttacacgaacaaaaataattctcctttatcatatcacgaaacggaaataactgcaaattaataatgtgttcattcatgttttatttgttaaacctgtcgataccagtgcaaaataagatgcctattaatagctatggtttgaaaacaccgtgaaaatgaatcacgagtgccttcaaacccagtacttcatattgattgttaaagatttctttaaaaagctcagctgtttcttgttcaagtacaagatattcttggctgttcactggtacagctttgtttctgcagatgtttccaaacgatcactcaggtatacccctattttaacggtattaacttgtcatgtttgttcctcaaacaatcaaaatttacggtctaaataaaccgattcacattggggagcatggagagagtttggcccgataaagagccgggtataatcttcatacgctttttgtatcccggctggccattgctaataaagatttaatcgagatggaaacaagtatctcatttccaataatttcacagacgaatgggaaagatacttatcatctatggtgtatgacgctgtgacttcaaagacaaacgttttcgatacttagaagaacatcagggaaggggaaatctttaaaaaatgaatgaacaaaacctaaggactttgagaaaactggttacaccctatgaaaagtccgatttacaaaaaagtatatgtcaaatcattaacacattggtgccatttttcctgctatggtatttggcatataagagcttgtccatttcttatttccttacattagccatttctgtcgttgcagcaggttttttagtaagaaccttcatcatctttcatgattgctgccactattccttttttaagaaccgaaaggcgaatcgaatccttggaacaattactggaattctgactctgcatccgtttgatcattgggcacacgatcattctgtccatcatgcgacaagcagcaacctggacaaacgcggtacgggcgatatttgggtactgactgttgaggaatataaggaagcctcaactaagacaaaaataatgtaccgtttgtacagaaatccgtttgttatgtttattatcggaccgatttacgtcttcgggattaccaatcgttttaatcgtaaaggggcaaaacgcaaagaacggatgaatacatatgtaacgaacctggggatcgtcgctttggcagcacttttatgttgggctatcggctggcaaaactttctgctggtccagacaccaatttttatgatatcgggatccctcggaatttggatgttttatattcagcatacgtttgaggattcatatttcgaagaagatgagcattgggaatatgtaaaagcagccgttgaaggaagctctttttataagcttccaaaagtcatgcaatggttaacaggcaatatcggtttccatcatgttcatcatttaagcccaagagtcccaaactataagcttgaaatcgtgcataacaacactgaaccattgcaaaacgttccgaccatcacactggcaacaagtattaagtcgttaaagttccgcctatgggatgaagaaggcaaaaaatttgttggttttacccactttaaaaaaacttctaaaagccaggtatcagctcggctaagaacggattaaataaacgcccataatcaatgataatgggcagtgtatcttgcataataaaagtgcagactcgcgcaaagattttgtgcagaggtcagcacttttttaatgccacatgcacttacaacaaaaaaataccaaaggtgtcaaaacccttggtatcattgagatgcgcccgagaggacttgaacccacgggttattcacccgctgggccctcaataaagtgattctttattatgaattacaaaagcctataatatcagcatttgtttattttgattatgaatgtttacttcgatttatttttatttgggagtaaaaatggagtaggttttcatttcaagacagttaatgtcttgttactggtgacatgtctattagagtaaccgcctaattgaaatggctagttctccatgttttataatgaactctggcttgatgaagtttttctatgatttgttctagctttttatctttccatttcttaatcagcagaactcgcggtttgtaacaccttaatattgcctttcaaaatcctttgcataaacgatcttaactttttgactgttttctttgtattccccttaaaattgaataatcactttcccttttggccgtccatttgcgactagttctagcgcttcatttacgttgtctatggtaaattgtattggatgaattgctggagcaatgttgttttcttcaatgattttggtaatctctttaagttgtgcgccgtcagaacgaacgaagataaaatggtattccacgttttgtttcttggctttgcgatcatactttgcgccaacaagggaaaatagcatttgtttccacaatggaaaattccggtcttttccgaagcgtttatttggtcctgtacggagagagagcaatcttccgcccggtttgatgatactcaattcactgtcaaattctttaggtcccagtgtatcaatcacataatccacatttgacaacaagtcaacatagttttctgttgaataatccaaatattgatctgcacccatttccaaaatgcgttcgcgcgcttctgagctgccgctaacaatgacatttaggcccattgcctttgcgattggtacagccatctgaccaaagctgcctgatccacctggaatgaagacagatttacctgactgtgcctcaagttcttcatgcagaccttgatacgctgtgagtccagccagtggtgcagcagcggcttccacgtaagacaaattttttggcatgggtgcaattgcggcagcatcaattgcggcatattccgcaaaagcgccaattttttcgagggggagacgtgtatagatggcatctcctacgtgaaattctgccacattttttccgactttttcgataactcctgtcaattcattaccaagcgttaatgggaattcataatcttgaatcagtttcacgctgcctgtaataattaacatttcgagtggattgactgccgcagctttgacctttaccaagacttcattgtcatcgatttctggaattggaatgtcattgatttgggcatagagatcttttgaatacttggtgatctgagctgctttcataagtgttttcatttttttatcagcatcctctatcatattacgtttattaggtttttacctttttatataatcgtttaggtggaggggaatctttcttttagcgaagtctgacttccaattttatgattaaccctccacctaaacagcagtcatttttagaacgatcattctcaaataattaaattttatagaccgatactgtgaataaatgtttctcatcttcctagtgttattgatgtagagcatcgttatataggtttaataacttgaaatattacatctctagaatcggatagatttgatctcttaattgaaattcatagtttccgtctacaactcctactacttgattactatcataaagctccatcataaaactcgccacttgctcaactgtgtggtacatcgggatatttgctttgtaatcatattctttcgtatcagatgcagttttcatgaattctgtttccgtgattgctggcgctaaaactttcaccttcattttcgcacctttgcgttcaagttcttttgcaaggccttctgtaaatgcactgacaaagtatttagatgcagaataagtaatactgccaacagcaattgcatatccgagtgctgatgatacgttaattaactgagttccctctacatccgaataatcacgtacaaatagtgtagaaagaatcgttaaggattctacgtttacacgtagcatggtttccactttatctaaattctgatccgtgacagaagaagattcaccaagcccggcattattaatccaagtctcaatttgatattcctttaaattgtcatacagtgtgtatgcctgagctgtgacagataagtcacttgtacgaataataacatccaaatcaggattaatattctgaatggttgatttaagctcttctaatttatctaatcttctagctacaataattaagtttttgccgcgagcagcaaattccaatgctgtctcatatcctatacctgagcttgctcctgtaataactgtgtacttcatattattctctcctcgaaaacaaattttctaattagttaatccatataacaaaatagattcagtctagtgtcgacaaagtcaaatcaataatgttttctaatttttccttatcatttgtcgtttttgctaatactcgtatccctacgagtgaattatgaataaattgagaaagccctttaatgtcatggtgtttagaaatttctccttgttcttgaccatgttttagcagatcaaataataatgcttccgcatttataaaaatctctgtgattttcttagctacttcttcatctattagggataattcaacagctgcattaacagctaaacatccttttggctgatcttcttttgggtaaataaccatttcaaataattttcgtatagccagcttaaccgttaattctgttttcacttcattcttcattcttacttccattacttctacatagtgacttaaggctcgcataaataaagtatgtttgtcgccaaatgtatcatagatacttctgcggtgaacgcccatatggtccaccaagtcttgcatggatgttttttcatacccctgttcccagaaaaggtccattgcttttcttaatgcttttttttcatcaaattctttatttctagccatgttatccctccttcattcttaaataattaaagaacgatcattctcatttgagcagcaaaacagttagatctgacgtatttcaagtatatcaaatttaagaacgatcagtaaagaatttagaattaaatcatgtgttttatatgctatgcatggctactacctgaattttaacgaatatcgctcctttttatttttcatcaaatcatttctttaatgtcattgacggcaggtcataaagcatactggtgtgttttcgaaaatacccctcatttcagtaaagttccccgctggaatattcacactttggacacgaaataggaactgtagaagagtttcccggattttcaaactaaagtgtattaaacaatacggaggattacactgggtaacacagtcaaataaaaaagctctaactaatccaaaaagttgctagtcagagctttttatacatatttttttggtccaactcactaagcacctactctgtcatcagcaacttgaaaaggagctttgataatagggacattatttgttaaaaccactcctgcgatgctgcccaataaaatgactgtaaacaaagtcaggctgatcttcattaataatctcccctttttttattttttcgtcccgctttaatctcagtcgataatactcattggaacgtgataaatcccctttttcaaaaaataatcagctgctctgattgcaaaattttcaatgtctccgaacattcttagaaggaagataccattagcgatgacactaatggtaccctttgtttctactcaataacttattcagcttctccaacaactgtaaagcgttcatttatatgttttggattttcaatttcatccaatactgcaattgcatagtctgcatagctgatataactttcacctttcgaattcacaagaagatgatcttttcctgactgataaaatccagttcttttcccgtctgggtcaaataccgctgaaggactgataaatgtccagttaatatcagaagtttcctttagttcttgcaagttacgaccttgccctttagctgtcggaataaaaatctccgggaaatcaggtgtatccattacactgacagttttattttcgtctacataaagactccctgctccacctacaattacggctcttgtacccgttccttttaatgccctaattaatgcccggccagcatctacatgtgcctgttcttctcctaatggagcaccgaaggcattaactgctacatctaacttttttagatcatccgatgtaagatcaattatatttttttcaatgattgcaatcttttcctctttaagttttgcagcatctcttacaattgcagttacttcatgtcccctgcttaccgcttctttcaagataagacttccagcttttccggttgcaccaatgattccaattttcaatttaaagtcctcctaatcattcaaaattttaaatgtaaccatatcgattacatgtaataagtttagttacaccttatttatttgtcaatacttttatcatcttgttaattgagcatattagagtaaaagaacttgtaatacattcagttacaagtgtactataaagagtgtaaagtaatgagggtggtgaagaaatcatgtctattagcagccgttttgctgtaggaattcatatattggctcttattgaaataaatgaagacggaattagcacttctgaatttttagctggaagtgtaaatacaaatcccgccttaataagaaaaattatggggatgctgaaaaaagcaggtttagtaaatgttcggccaggtattgcaggagctgaattagcgaaggatttaactgaaatcaccttacttgatgtttatagagcagttaatgttgttcaagataaagaattgtttagtatacatgaaaatcccaatcctcaatgtcccgtaggccggaacattcaaagtacaattggtccaatatttgaaatcgcccaatctgccttggaaaaagctcttgggcatatcacaattgaggatgtggtaaaggatattattgaaaaagaaaaattgaccaataatttttaaatgatttcacagaaaatcttttatcagactggggataagaaaaatggctttttgatgaaaaagagcagacataaaatctactccttttgatgaaagatttagattacggtaagggatataaatatgctcatgataaaaaattaacgacaatgcagacgatgccagattctttaataggacgtgagtattactatccaacaactcaaggttcagaagctaagttcaaacaaagacttgaggaaatctcggattggtataaaagaaaccgcaaatcttagtttgaacgaatatgttctgtatataaaaataatgaggtatggagtgaattgataatgaattatggtgaaataaaagattactgcctaacctttccaaactcttatgaagaccatccttttggagatggttggactgcaattcggcacaaagggaataagaaaatatttgcacttatcttcactcgcgacgaacacttatgtgtcaaccttaaatgcgaacctaaaagggctgattttttacgtggtctttttgaagaaatcaagcccggataccatatgaacaaggagcattggaatactcttaccttagatgagggactcccagagcatcaaatccatgacatggtaaagtacagctttgaactgacaaaaccaaaaagtaaaaaggaaatataacatcgaaggatagaacgctcattataattattcacccggcgcaatgatacagaggaatatgcaaaaaaacctcaaggcagcaatttttaaattcgtatttacgagatgattttttcgttattgtgagtcctttgtttctcgacataggttgaacaaataaaaaaagagcagactcaaagtccactcaattaatttagatgattgcttatttcatccagacacctataaaaattgaaaggtgacgatgatatgccgcaaaggtcatttagcgtttaattaatactgataactcaccttcaaacactttttcctctttctgattataggtagataacaatacagtaagtatccccgtctggcttttatttggttttttatcaataaccttaacaatagtgttcagtttatcattagggtaaacaggtgctaggaattttatattattcattcctgtcccagcaataatatcgtcttcatgacacccttcttcaatccaaagcttaaaagtaatagataacgtttgtattccagaagcaataattccattaaacctgcccatttttgctttttcttcatttaaatgcatgtattgtgggtcatacacttctgcaaaattcattatattctcttttgttaattcaaaagatttagtttgaaaaacctgcccgacggtgaattcatccaacttcataaataaatctccctgaatctaaactttattattaaatctacgtagcattttaacatactggctctcacacaacaacttaacggtaaaacgattgttcccctatcaggaatgaacaagcacattgtttttgtttccttgcctttaacctctttataatcaggtgttttcttataaagaccaaggcggtcgccatcaccatcacccggcatatgtgccatttcttcataagaatccccaagcttctcataataagaataagcagtaagcttgcgagaactttcttctggctgataaaacgcaagttgaatatacttcccgtcatcatatacaagaattatggcgttatctcttttgtactcatctgaatctgctcgcatttcttttctgactttcttctcctgcttcatcacttcattaatcattatcatatttactgccgccgcacgcagtcagcagaaggatgaaggtgactgacaaatcatacgacctactataagtaagtggacagtaacagataaatttctataaacaaaaaataccaagggtgtcaaaacccttggtatcattgatgcggccgagaggacttgaacctccacgggttattcacccgctgggcccaccagctatattcataaaactattgctcagttgtcagcatgttaagtaaattacgaatttccttgttataacttttaatttcttcttcattacaaccggttttatcaaatactgcattaggtatcattgtgactttttctttaaactcattccctacagttgttaacgtaataattacacttcgttcatcctcttttgaacgctctcttataataagacctcgctcctcaagtcgttttaaaactggagttaatgttccggagtctagatataattcttcgcctaaacctttaacagatattttttccttctcccataaaacaagaagaaccaaatactgtgattagcgtacaagttctcgttttctgctttggaccccatatagaaaataaaaagccagctctccttcgggagaagaactggcataataaagcttcttgcttcttattttgctgtattgctcggaccttttaatttctcttcgttcttgcgtcaacgttttattattaggacacaaccaataaaataatgacgatcgagaatagcaacgctgcttttgcaaagcagtaagccctccagaatataaaagagctgcagtcattgctgctcggataatcccagcttattctgagtctgtatttcgagtagccggtcaattaaatggatgtttttttcattccttttctgtttgttccattttccaccacagtgaatcttttggattttcaacagcttcttgaaactcagctttagaagcaactgttgggtaagaaccttttaaagatttacctgaagtatctttaaataaggttaacacaactattaagccaattaaactaactgctaataaatagaaacccggcgccaaattgtttcttgtcacatgggttaaccaagaagcaactaaaggtgttgttccaccaaaaatagaaactgataagttgaatgtccaggataatgtacgatatctaatgtccgtatggaacaacgtaggtaaagatcctggcatagtaccttcgtatacagataatacaatacctaacattaaaagtcctataaataagaatgttatattccccatattaagaaattgaaaagagataatcgaaaatacaattcctaatactaatccaattgttataacttttttatttcctaatttatctcccaatttaccaaaagttaaagcgaacggtaccataataatcaatacaattgctgtaaccggtgtacttatattatcacttataccaaggttctcatctaaataagaaggcatataacctaacaataggtaattggttatattgaaaaatgccacaaatacgatacataaaaagatatcttttttatatgttttaatgacttctaataaacctggttgttgttcttggctttcagagatgtcattttcaaaaattggtgattcatctaaatgacttctcaaatataaaccaaataatcctattggaatacttaagaagaaaggaattctccatccccaactattcatttgaacatcagataaagtccagaaaagtactgtaactaaaacagaagctactatataaccagataatgtgccgatttctaaaccgctgcctaaccttatacgcttattatctggagaagattctgcgatatataccattgcaccagcgtactctccacccacagaaaaaccttgcagaatacgagctaagagtaataatataggggcccatacaccaatctgatcataagtaggaagcacaccaattattaaagtagataaagccatcattaaaatagtaattgttaatactattttccgaccaaatttatcacccattttaccaaaaataattccgcctacgggtctaagtaagaaggcaattgcaaatgtagcaaaagtaaatattaactttaattcatcgttttgaactggactgaaaaagtttttactaataataactgccaaataagaatataaagcaaaatcaaaccattccatcgcgtttcctatccctgtagcaaacacgcttttcttcgctttttgaatgtctacaacgttaatttttttcttgttaaacttcatttaataatatcgactccttaattatcaaatccacattatacaagcgcataaaacggtccaagcatgcagtcccagaatgtatagcgtaatgcttctctaaaagtctgggggtttctgtttcacctgatggagagctaacggcatagtggatgattggttcaactgtaccttaaaagactagactaatatccatatcagcgccgaataacattgtaaaccaggaaagaaggatgaaattcagttttttcgctggtttccttaacttatttttgccgattggactaaaaataatacaaaaagcaacaaaaagagaaacatccaacagataataccagccaaagcggttagtgatatatccttgggctgtggttggcattttctgcagactatttggagaaatgattccccttaatacagctctattgtgaatattatcacattcgaaaacaaacttttatttctccaaagtatcctaaacgtttattttagttcttccattacggcttccaatatgtttattataagatcgaggtcgttcctaagaattatttactgattctatctttattaccccacaatcaggtgaaacaaaacactataaacgtagcatacctttttaaaatctgacaagcccaacagggtgatagaaacccggctaaagcccagctagtcaatggatagaagaaatttttttgtttttcccaaggaataaccgtctgtgtttaatctagcccaattagaaagaaaaagagcaggagtaatcctgctctttcattcaaaactttaatttgtatgaagaatttcgtataccttttcgactttctttacctattaatcagtatgcagactacaacagaaataagtagcaccgggtatgaaataatggatgcatttaaacaggccaatcaccgacaattgaatttaggaaaaagcgttaaattctctcttatgatgttgttacgtattgttgacggtaaaattattgaacatagatctcatgtggatgtgcatgatattctccgtcagcttggcgttaattaacaggaaaaagttgaaatagtgagagacctggtgaatagcttggtctctttttttataattaagtcctcgctctatgcccccctgcattcagtcgatgtaactttgaaataaagtttaattaacatctatctatcacaaacccttattttcacaacacatcatttgtttcagcttccctcgcgaataccggatcaatgctcagctttaagatagtcaaccaatttctccgcactgttcttaacatcttcttttgaaaggtgaagcgtcccatattgtgtaaaggcaggaagaaaacgcattcctacatatttagcagtgacttgaaacggtctgataagctcgctgatcgtgatattatattctccgcctgcttgataatcagattcctgtgcgcctaaggagatcgctaagagcagttcttttccatgcaatttagtacctccagttccataagcccagccatgtgttaacacatcatcttcccattgtttgagtaacgcgggactgctgtaccaatacattgggaactgaaaaacgatacgcccatgatctaacaggagctgctgctctttttctacatcaatgataaaattagggtattcaccgtacaggtcatgaactgtaatgtcattctcttgctttaaacgattcatccaggttctgttgacaacagacgtttccaaattagggtgtataacgataactaatgttttcatttgaccgttatcctttcttcgcagattagttattattgcttttgtgataaagaattgattctaattttaaaataacaacttatttacacctattttatcctttttcatgaattcagggcaactaattggacaccgattacatttatagccaaaaaaaggcttagccttttaaaaaagattaagccttttcagtacccttatgcccctaccctattatctcgtgtctaatttctaatagctgatcatataacaaggcatctttgttttcctccatgcttagcaatactttctctacttttgcaaattggagtttgaggcattagtaactacctataatgatgaaaatatttgtgcgatgtctactgcagatgacttactttaggtaagcgggcagattgtgggcagtagatcatttaaaaataagcacaaaaaaataccaaggatctctctattacccttggtatcattgatacggccgagaggacttgaacctccactggttattcacccgctgggccctcaacctagtaaaaacctatcatgagttacaaaaaacttttattcaaagcatctgtttattttatttatacttattttcatcatttttcatgaattctgagcacaaactgggcacctattagagaccaaggaaatctgcatttcatcaagaaatatgcactcatcgccctgctgtaattagtttcacatcatttatttcagcttccctcgcgaataccggatcaatgctcagctttaagatagtcaaccaatttctccgcactgttcttaacatcttcttttgaaaggtgaagtgtcccatattgtgtaaaggcaggaagaaaacgcattcctatatagttagcagtgacttgaaacggtctgataagctcgctgatcgtgatattatattctccgcctgcttgataatcagattcctgtgcgcctaaggagatcgctaagagcagttcttttccatgcaatttagtacctccagttccataagcccagccatgtgttaacacatcatcttcccaccattaatttaaatctcgtaatttcatttttttcagattcccattgatacatattcttgcaatgttttaatgtcgtttactaaaattgaattgagtaagggacccatctttcaggagttccacccatcttttcgtaaaaacgctgagctcgtttattatcatgagcagttagccaaaacatatcagcatagtcattgtctttagaaaatttttcacatgctttgaagaggccattcgcagcatctgtccccctcgcatcttccaaaacgtataaatcatttagtacacttgttgtttgtgcaaatagtgtattgtaagtgaaatataatgtagcaaaaccaactagcttatcattttgttctgcaacaaattggataccttctttttgattaagaagtgtataaaaaagttggtgaactttttcaattgaaggtttcggtctctgataaaaatcaacgatatattcatacattatctcagttaattggtcaatatccttagcttcagcttttctaatattcgtagccattacaaatcctctccccttttaatatgtttttatatttatttgatttgtattaaaaagttgttgctaactttctcgcatctgatatacctttgtgaataatttctttcgcttcgtctcgattgaattcatgtccttcaacatataatactgctacatcctgtataccaatgatattaagtacatgttttaaatacgggtggctataatccattttcgcaaaaggttcatgcgagtaaaccccaccactcacctgaatgtgaatagctttttttccttttagatgaccaaccggtccattctcagtgtagtgaaatgttttccctactacaacaaaggaatcgatgaaagctttcaattttggaggaatcccccagttccacataggagatacaaatacaaatttatcagcacttgctaccctgtcagtgaaattattgagtgcgttaattttatgcttctctacttgccttaactctgaaccctcatcccgcaatttgtcccagccattaaggatatcttcatcgattattgggaattcatcttcatataaattaattgtcctaatttcatcccctatatgagattcacgataagattccagaaacgcacgtcctaccctatgaccaactgaattttcaactgattttggattagcggtaatatataaaattttcgacatattaagtctctctcctttgtgaagaaattccatattaatgaaaaatccaaggctttaattatgaagttacactcgctctgaattattaagtgactaataatttaaaaccaatacgccaagatggataagtgggcttccaaccatattctcttttcgcttttccatttgaggccccacgttttcctcgttcacttccatctataaatattggttttggtgctccgatctcgctcgcaaatagcgtgagacattcttttcccgtggttggttcatcatccacaatattaaccggtccattcggccagtttaatgcttcaactgaggcttgtgctgcatcttccacatgtaaaaatgatgtgatgctatcatcggctttaatttctccttttaatacctgccgaccaatcattccgtttttttcataccatgtacctgatccgtaaagcagcccatgccgcaggatgacatactcgggtaattcagcaactgcggattctaatgatgccactccaattacatttattttccttgaattcggcgcgttgagatctaaagggacatcttcattggcaggtattaatccgggttcataggccatagaaaggctttgagcaattatcctcttcactccaactttatgacacgcatcaacaatatttctcgtacctataattctgattctcgcgttttcttcaagattgtaacttgttaaagaggtaagctgatggacaacaacctcaggttgaattttcctaaaaacattaagaacagcatctcgatccattgcatctgcttttacaggagttacccctattcttttgaggaacgtgttcgaccgattacctcgggtcaatgcaaatacttgatggccgttttgtattaatttaggaagaagggaccgaccaattactccagtccccccggcaacaatgatcttcatgctatttcttatttacctgctaatcttgaagcagcttcttcaacttctttatttgctttttgtaaaacatcctccggacatagtaaagctgttccttgcactcggataatttgataatcctcaataccgaggaaattgaacattgatttcaaatatttattagagtattcaacttcttcataccagtcatcatttgtataaattgatccgctagcttgtatgacaagcattcttcgtccatctttaagcagacccactgacccagtgtcagtatatttaaatgtttcgcgtgcgatcatgatattgtccatatagtcttttaattttgatggaatattgaaattatgcaaaggcaaaacgatgacatacgtttttgcacttttgaattgtttcaatacttctgtcatgcgttctgttactttttgttcatcgcttgtcagttcttcgccctttccagccttatcccatgcgcttaaaactgttttatcaaccataggcacttcatcactatacaagttaatctgctcaagctcttcactctctggaattaattctttgtaaatttccaaaaagtgtttcattacccgtaaactatatgacaacgtatcatccacttttggatgtgcattaatgataagtgttttgctcatttaaaactctccttttattttatattaaagattaatttaatcgacgatcaactcggtctttaatataaaccctgcagtttattttgtcaaacggaacaaatcatatactaaagaagggttttatgattgactatcaccaaaaatactcctaagatacaatatgataacccttaaaatcaaaagcaggtgagtttatatgcagtacagtgttggggttgaatatgctttacattgtctggtttatttaatagatgttccctccaaggaaagtgtcgggattcgggaccttgcagagttccaaggactttcagaaacatttctttcaaaagttttcggtaaattatctaaagctggtattgtaaattctgtccctggtgtaaagggaggatataggttagcaaaatccccagaagatatttccttttgggatgtaatagaggctgttgaaggaccaaaacccatttttcaatgtaaaaatattgtaagcaatggtctgctttatcgtgacaaatgcaactcctgtgaatccagcaattcttcttgtacaattaacttggtaatgcttgaagcagaagaacagatgcgtaattatcttcgtaataaaacgctcgcatggttaaataaagaattggacgtagtattgcctaaaaaaacaaggacagatactcgggaatacttcataaaaaaaagctctgactaaattaattagtcagagcttttttgtgcttcaagatgcctttaaattacaagtcatattatgttttttcgttttccttctcggcgtttgaatttgtaaaaacaatgccgtacgtattggtgcttctcttgcataagaaagcgcaaatgttatactcatattaaagactatattaatcgccgatttatacggtctcttataaaaaagaataacaatcttcttttttacagattaatttcaaaaaaggaaggagaaatgtaaaatgaaagcattaatgactctgtatcttaggctcgctttaggaattagctttttatcttctgtagccgatcgattcggactatgggggacacctggcaagcctaatgtcgtatggggaaacattgaaaattacacggattatgtcgctgccttaactccttttataccaaatgctcttgtaccaatagcaggatggatagcaactatgtttgaaaccatcttaggaatacttttgatcattggtttcaaaacaagaataactgctgtattgagtggtgctatgttgattattttcgctctaggtttaacagtaggaacaggttttaagacttctcttgactattctgtattctctgcatctgcaggtgcattcatattaatttattttaaaagagtaccctatagtatagatgctttactcatgaaaaaaactgtagaggctgaatcattttcacttgagtcagacaaatagccctcaaacctctaaaagatagggaaagaaatatcgaagcataaaaaaggagcagacataaagtctactccttaattttcggtttccttccctttaacttcttcataatcaggtgttttcttatacagaccaagtcggtcgccatcacccggcatatgtgccatttcctcataagaatccccaagcttctcataataagaataagcagtcagcttacgagaactttcctcaaaaaaataccaagggcgtctgcaacccttggtatcattgatgcggccgagaggacttgtacctccacgggttactcacccgctgggccctcaacctagtgaaaacgtatcatgtattacataaaccttataaataaagcattctttatctacatttccacttgttttcttctttttttcgggcaaaaattaggcattactttttttaaaaaaatcactgaaaatattagctttaaatttgtaattccagctaagatctaagaaaccactaacaaaggaagtaaggtggtctcgcccaataggtgcgatagttttttcttttggtagtatcttgacttgtccgattttgagtaaaaaagagtacgtattaatcttgaatagaacaaaaaacactacccttttcgttactttagagaaaggatagtgttttttggttttgcgggtatcggaaaatctttagtagcagtacctcaataaaagatcgcaaattccacttacctagctatatcaaggcttacttgtctgatttgggatgtatggggtacaaaagttgagttacaaacattattatccaaaagaatgtttactgtaattattttacatggtattatttgtatcatgcatacgaaatatgtatgtataataaatgaaattaaaaggagtgcttgatcgtgaatcttaagtccattttcaaaggagtaacatcgactctgatagctggtgtaattgttggaacttgtactatacctgcttttgcggagtcgactacaagtgtatcgtcgaaaaattatgcagttacaagtggagtattcaaagctctagatagggaaatttcagagggttctgttgatcaatcaagctggagtcgggagttcgaattagatgagaatgacggagcacaagtaaacttctggatttcaaataacggaagtaatgacataaaaatatcaattgatggaaaagtctcaagaaccatcgcaccaggcaagcaaggcaacatttctgccgaggttaaaaatggttggtttggttggacatacaattacacatttacagcttcaccaacggctcaaggtggtagtgttaagatgaaatataaaattgctcaaagaaataattaacgaattacggaaaggtaatcacttattacctttccgtaatttcatcatttttttagttttttaatagattccttaaataaaaggtttttgtattaaatcctatatgatgcaaatcaaaccgattagtaattacttttctccaattttcttctcctgcttttcctgctcttttcccctcaaccttacgagtattatcatgtcctatatttaagggttatacagcgctcgttatcattatttacaccttttttgatgttttttcatattttctggacagtaaatgggagtaaagagaccttgaccactcaccaagataagtaaaataaaaaacgaagggcatcaaactagatgacttactataagtaagtgggcagtaacagataaatttctataaacaaaaaataccaagggtgtcaaaacccttggtatcattgatgcggccgagaggacttgaacctccacgggttattcacccactaggccctcaacctagcgcgtctgccattccgccacgaccgcgtgctatgaagctgtctttccactaagcatataagctagtgatgatgatcagcactttgaaaagaaagtgcgggtgaagggactcgaacccccacgtcgtaagacactagatcctaagtctagcgcgtctgccaattccgccacacccgcgtgacaagtggtgagccatgaaggactcgaaccttcgaccctctgattaaaagtcagatgctctaccaactgagctaatggctcgctctaaaagtgattcaaaaattttaaataaaatggctgggctagctggattcgaaccaacgcatgacggagtcaaagtccgttgccttaccgcttggctatagcccaacgaaggtaaatggtgacccgtacgggattcgaacccgtgttaccgccgtgaaagggcggtgtcttaaccgcttgaccaacgggccgtctggttgagaacttatctggcggagaaggagggatttgaaccctcgcgccgcttacgcgacctacacccttagcaggggcgcctcttcagccacttgagtacttctccatatggctccacaggcaggattcgaacctgcgaccgatcggttaacagccgatagctctaccactgagctactgtggaataatcagactttctttattataaatgatgcgacatattgtgtcaagaagcaacatttatttttttaagaaagtgtcgttgtctctcaacgacttttataatttaacatagaacattaaaatgagtcaagcctttttaaaaaattcttttgatttttcctctgcactttccgcaggcatatctttccggattcattgcccgcttctttatatactgttggccgcaggccgcgcatctatacatatatgttttcttttgtgtctttttggtttgcagcggcgtgcagaatctcggcgctccgactttctgaagcaggtctctgaaatctttgtctctgtgcttgtacccttttccttcaaggtgaagatggtaatgacacagctcgtgtttaatgattccttccagctcgctctgcccgtgttcgagaagatattttcggtttaattcgatgttatgggaagacagcatgtaccggccgcctgtcgttttcagccggtcattgaaaaaggcccggtgacggaacggttttccgaaatcctgtgcagagatgtcttccgtcagcctttgaagttgttcgttatccataagtgcaccccgctttaaaaacattgaacgggacaattcaccgttcgcatacaatgagttaaaaccgacctctaactaaaagctgaggaggaatgagccatgccgaattggctgatgaaacaaatgcaaaaagcgtttttagaaaaggacaattaccaaattaaactgctgaatcagtgctggtatttctacagaaaaaaacactgctcgtaagcagtgcttttattttaccatagacagcgacactctgcctttttgcacgtccaccccttcgacccatacggtgacgatgtctccgaccgatacgacgtcgagaggatgtttgacgaattgattgctcagttttgaaatgtgcacaagcccgtcctgcttgacgccgatatcgacgaaagcgccgaagtctacaacgttgcggacggtgccctgcaattccattccttcctttaaatcctcaagctgcagaacgtcttttttcagcaaaggcttcggcacttcgtcacggggatcgcgctccggccttgtcagctgcccgcaaatatccgcaagcgtaatttcccctataccgagctcttcagccgtttcagacagcggcagtgcgctgattttctcttttacgtccgcgcttccgatctgatccgcagtgagctgcagttttttgagcagcgcctttgtctctttatagctttccgggtgtatcccggtgcggtcgagcggttcctgtcctccgggcactctcaaaaagccgatgcattgttcatatgtttttgcgccgagacgcgggatttctttcagttctttgcgatttgtaaatttgcctagttcatctctttttttgacgatattgccggcaacggttttggataacccagctacatattgaagcagcgcggctgatgctgtattgacattcaccccgacttggttgacgacggtctctacgacaaaacggagagattcgtttaattgcttttggctgacatcgtgctggtattgcccgacgccgacggatttaggatcaatttttacaagctcggccagcgggtcctgcaacctccgcgcgatggagacggcgctgcgctcttcgacctgaaaatccggaaattcttcacgggcgatttctgacgcggaatacacgcttgctccggcctcattgacgatgacataataaatgtcacgctctgtttctttcagcacatcaacgacgaattgctctgtctcccgtgatgccgtgccgtttccgatcgccacaacctcgacttcgtaccgatccagcaattctttgatttttttccgggcttccgctgtcttttttacgggagcgtgcgggtaaatgacgtcgattttcagcacttttcccgtctcatcaacaactgccagtttgcaccccgtacggaaggccggatcgacgccgagcacaactttccccttcatcggcggctgcagcaggagcttacgcaggttttcagcgaaaatatgaatcgcctgcgcgtctgctttttctgacagctctttgcggatgtcgcgctcaatagccggctggatcagacgtttgtaactgtcctcaatggcctctttcagcgtttctttcacaggcgtttcacggtgtttgataatttgcttttctaaataagcttttatctgatcggcgggcggttcgatcgcaatctttaaaatgccttctttttcaccgcgattcatcgcaagcactctgtgaggaacgaccttttggatcggctcttcgtactcgtagtacatttcatagacgtttttctcgtcatctgcggctgacttgcctgccgcggaagtgagaattccttttttatacgtttcctggcgaatccactttctgaaatgaggatcatccgagatttgctcggctatgatgtgcttcgcgccttcaatggcttcctctcttgaagcgacttctttttctgcactgatatattgatcagcgatgtcgtgaaggcggttttctttcgggagagaaagaatatagtccgcaagcggttcaagacctttgcttttggcgacggtggcttttgttttccgtttttgtttgaagggacggtataaatcctcgacttcctgaagcttaaccgcttgttcgattttttgcttcagcccttccgtcagcttgtcctgctcagagatcaatctgatgacttcttctttccgctgcgtcaggttttgtatgtattgccaccgctcggagattgcctgaatctgcacctcgtccattgagccggtctgctcttttcggtaccgcgcaataaacgggacggtattgccgtcttccagcaggcggatgacactttcgacatgtttttgggataacgctgtttcttcagcaatttgttttttcaaaagggctaacgtttccatatcacaaaagcctccatctcttcattctttctctagtgtatcaaaaaacggcggaacataaaaaaagcagccttacgataaaagctgccctagaatataggtcaaatcatcacgtctggatgttgtgtacggatgaagtgattttgatatatcttctattgagtgtccctgctttaagcaggtgcggatatgcggaacctcaagcccatccgtgtagatgatgaacctcgcccctttttcgtatgatgacgtatacgttttgtatctttgcggtttgcctgagaggtaacccgaaatcggcagcggatgaaagacttcgcctgatggggagtgcaagaagaaacggacgttgccgatcgagcagtatgtcaattcccttttgatgaaattgatttttaagatggaggcagtcgcccctcttttgtttttcatcgcttgattgcagcgctcaatgatgctttccacatcctcatccgcatacgtttccacgatgtctttaatggctgacgaggattcgttggcaagagatccgctgccgagaccgtccgctaccgcgcaaactaattcttcttcattcgccttcataaaaaagctgtcgccgcatatggacttgccttctttatttaattggtatacaagagtttgaacatgttcattttcttcaacctgaatcattacattagctccatggagggatctccaatcaaggcctctctcagttttttcaccgctttccgctgcaggcgcgagacgtgcatttgagatattccgagaatgtcccctgtttctttttggcttttattttgcacaaatgttagatcgataatctgtttttcgcggtcggacagcacatgaagtacgcttttgatcatcatctgctggttgacgcgttcgtatccttcctcctgcgaaccgacgatatctaaaatcgtgacggtgcttccgtccgcatccgcttcgatgctgtgatcgacagacagcgcctgatagctttttcccatctccatcgtttcaagcacttcctcttctgacacatcgagaaaggctgcgatttcttcgactttcggcgaccgctgcgtctctgtcgtcagctgatccaccgccattttaatgcgcggcccgagttctttaatccgtctcgggacgtgtacgctccatgttttatctctgaggaagcgttttatctcgccgatgatggtcggaatcgcaaatgcttcaaaggatttgccgacctcgggatcataccgtttaatggctccgagaagtccgatcatcccgacctggcggaggtcttcgtgaaagctttttccttttgaatatttctttgccagcatttcgacgagattggtatacacctcaacgagtgtttcctgggcttctttattatcatgtgtttgaaagtcgcgtatgagccgatcaacttcatctttagttagtttcgtagtttttgatggttgtgccatgatcaactcgctccccatttaaatactttgtcatcgccacggttacgccagagttgctttgaactttgacttcatccatgagcgtttccattaaatacagaccgagccctccttctgacaattgatcgactgtgtgcgaaggagtgtacggcccgagatcctgctgcttctgatcaaaatcaaagctgtctccctgatcggcgacaatgacctccagccgatcctcaaacacaccgaaccgcacggatacttctcccttattttcatcgttgtatgcatgctggacagcgtttgtacaagcttcgctgacagcgatttttaaatcttcaatgtcatcataggtatagcccattctgcttgcgacccctgataacgtaagcctgacgattcctacatattccggttcggccggaattttcatctctatataatcaactgatgtactcattgcacgccaccttctgactttgccgaaatgtcgatgatgtccttaagccccgtaatttcaaacagacggacgagccggtcggaaagattctcaagcttgagagagccgccttccttgctcaccgttttaaacacgcctacaaaaacgcctaaacccgtactgtccatataatttacatcttttaagcagattctcatgtccttcccctcgtttgccaggggcatcagcttttcacgaaccaccggagctgagtatacatcgatttctccagcgattttgatttgtatatctgaaagattctccttcatatctaccgttaaattcatcgtatcacctctgaaagttatccttactcgtgctaatggctttttacccgtgctgccgtttttttaaacctttcttttcaaaacaattaacgtaaaatcgtcatgaagctgaaagtcctggagtctcagcaggctgtcgtaaatatttttgaccatatcctgcgcggagcagtccatatgttcttccagcatgcgctgaatgtcgctgcgttctaagaaaccgttttcggtacggcattcggtgacgccgtcagaaaaaagaacgatcatgtctccttcgtccatgtgctgttcatattggctgtaatcaaaatcctgagaaattcccagcaccaatccttttgcctccagatcataaaactttttttctttttcagagtagtagaagcccggttcatgccccgcagaggcatatgtaaattggtgatttttcgtattgtagtttgcgtaaaacatggtgataaacatgcttgaatccacgttctgttctacaacgcggttaagatttttcagcacttgggaggggtgaatgccgatctccggaagagagtccatggcatacttgatcatcgacatgcacaatgcggcgggtattccttttccgatgacatcggctatcgcgatgttaatcgattccttgtctttgacaaagtgataataatccccgctcatctgtttggcggggacgctgatcgccccgatatccagatcttcttcttcaggaatttttgtgccaagcagcgtctgctgaacatttgcggcaatttcaatttctgaacgaagctcctgctggatatctctcagactttgatgttcctgataagccatcccgtagccaatcatgacttctattaaaaaatccagcgaatgaaaaacatcttccggcagatccggatacagttcctttactacttttcggtggatactgataatctcctccggaggaacctgatgttcaatcgtttttcggctgaatttttgggcttgatataaagatgtttctgttaattcggctatatatcggctaagcagctgatgataccgctgctctataacctccctgaaatccacgttctaacctcctaccgaagccatttcacggcttgaatctctgttccttcctctgcaacagattgcaggctgaattcgtccatcagccttttgacgcccggaagtcccgctcccagtccgcctgacgttgaaaagccgtcttccatcactttacggatgtcggggattccgggtcctttgtcttctgctataattttaagaccttttttccctctgtcgtttacttgttctatgctgacctggcctttgcctgcatataagtaaatgtttctggccaattctgagatagccgtcgtgattctggcctggtccaccgtgccgaagcctaattccttcgcaacgttgcggccaagctgtctggcggctacgatatcccattctgtcatgattttcacacaggattggtcgttcatcgctattcccccaattcccgcttcaatgtctcaagcccttgctctaaatcgagcgccgtttcaatttcctcaagtgagattccgagttcaatcaatgtgaccgccacagcaggctgaattcccgtcaatacgacctttgcgcccatcaatttagacatggtgatgacatcgccgagcactttcgcgataaatgaatcgatcatgtcaacggatgtcaggtcaatgacgaccccgtttgcgccggtttcatagattttgttcagcagatcttcttgaaaatgcaaagctgtctggtcgtcaagttcccattggatggataccaataagcagttatacagtttcaggatcgggatttttggatgtctcacaatgttattcccccaatgaaacgatttttcgatttgtcatttcaagcgctgtttgaattcctttttgaagggtattcttcgtaataacctgcgacaaatcaattcccagattaacgatcgtctgcgcgatttccggacggattccgacgagcaggcatttcgcgccgacaagccgcaccgcttctgatgcctgaataatatggtgcgccaccatcgtatcaacgaccggcacgcccgtgatatcaattaatacaacctgtgaacggtgcttcacgacgccgtttaacagattttccataatgtgctttgcacgctccgtatcaatcgtcccgacaagcggcatgaccgttacatgctcaaataccgggatcagcggagccgacaattcctgaagcgcgattttttgcaaagtaaccgtcttttcccaggagatagaatactgatttaaaatttccgtattgatcggattgaaaaagctgtctatttccaaaatcaaatctgctctgtcctgatcggccatattaaggtcgaccatcgtttcgtaaagcagtttccaaaactctgacagggtggctgaaagaagtttcagtgacaggccgagctgaacggcgcgcagtgcgagttcactgatctgctcttccgtagcctcgtcatttttagtcgataataaaagaatgtctatatagtctttacaaatattttcacatatgtgattcgtaagctgatagtcttcctgattgcctacttcttttagtttggctgtccaagtatcaagcagttcatcatgctgatcaatgatgaactgatacactttctgattcgacatgggtttcactgacctcccgacacaaaacaacaaattttgtttgattatctctttattatagcgcttatgtttttcgaaaacaaaaaaagttgctctatatgagcaaccaaaatatgactaaaaatcaatgagtgccaaactgatttgcagggcttcatcaaccttatccatcatttcatcatccagatgagttattttatccgttaatctttgcttgtcaatcgtccgaatttgctccagcaaaataacggaatctctttcaaaaccgtagcgttttgcatcaatttcgacgtgggttggtaatttcgctttctgtatttgggctgttatggctgcaacaatagcagtcgggctaaagcgatttccgatatcattttggatcactaaaaccgggcgtacgccgccttgctctgagccaacaacaggagataaatcagcaaaataaacatcgccgcgctttacaatcaaaatgattatcctccgctgactaagcgctcaacggtcgtttctgcttcgcactcagcatagtgagcctcagaagagatattcaagttgattttcgccatttccatatacccgcgtctcatcaaatcacggttatggcgagttgtccgttcgctgacatacgctctcactgcttgtgatatcagttcgtttctgcttcgtttctcccgcatcgctacaccatccaattcagctactaagttttcgggcaagctgattttcatttcggttcttgcgctggattcagacaaaaaacatacacctccaccaaacttacggatacgaccaattcatccatccagacataatgataccattattcaaacgtcaagcaaagctgttttataaattctctttttccggatgacggctacttgcttgtattatcttgcagtaaaggatttcttacttccattatactctcattttccaaaaacatacggggaacgcgggaactaatggtacaagggacctcgtaattaatcgtcccaagccgcccggcgatttcatccatcgtgatcgtttctcccttctggctgccgatcagggtgactttggtgcccggcggataagattgatctaattcgaccatcaattgatccatgcagattcttcccgcgatgttcatccgtttgccgccgatcagcacagacgtgccgctcagcttgcggagccacccgtccgcatagccgatgggaaccgttccgatccattgatccttctctgccgtatatgttgcgccgtagctgacgctttcccctttgcggatctttttcacatgggataaaacagagtgcagcgcaaaagccggctttaattgaaacggaatttcgctttggatgtcagcagaaggacgaagcccgtacatactgatgccgaaacgaaccgcgttaaagaagccctttttaagacgaagtccggcagcgctgttcgcgcagtgcaccatcaattcttttaaagggagcggagcgatcaatgttttaaagcggtcaaactggaagaggaaataatctctgtttttctcatccgcggtagcaaagtgggtgaatacgcctttacagactaaaccgggattttggctgaggatttttaacacgctttggatttcttcctccgttttgactccgagtctgttcatgccggtgtcgactttcagatgaaacggcactgtttcacttccgaggtggcgcgcagcttcctgaagccattcaacagaataccccgtgagtgttacgtcatactcggcagctgcttgtacatattcgggcggcacggcgccaagcacgagaatcggcgctgtaatgccccgttttctcaatgaaatcgcttcatccagtatggctacggcaagacaagaggcacccgcttcaagcgcggctttcccaacttccaaatctccgtggccgtaagcgttcgcctttacaaccgccatgagatggacgttttgcccgatgtgttttttcatatgcgtgacattttctttaatcgcggacagattgatttccgcccacgtttctctgtaaaaggatgctgtggtcattcgatacacttcctagcattattttcaattcatattgttattatcatactaaaattattctgcaaagtgaaatggaatcaaaaaagagaccgacagcggcggcctcttttttgacgttattttgacgactgtccctgcatgcttttggcggcggccaccatttcatcttttgtcagatcctgtgatgacagaagataatccactccgtcatatgtccacgttaaagacgtatcagataatgccgcaaccgtgaagccgagattaaccggttcgcctttcagcgtgacggcagaggcggcttttgcgatatgagctttttcttgaataagggtgaatgatttttctccgccgtaagtcatgacgatccgtttgccgtccgccgttgaaatatctttctcttcaagctttttgacgccggccggcacttgaagcggtgttttgaccgcaaatgaatcagacggcttggcgcttgtggcgacgtccatctgggaaagcgtcatatttttcttctcgtcaaaagagtctttatcaaacggcttgttgaattcaaagcttttgaattcgacttttaccatcactttccggtctgtatccatgactttgacgagcgacgggctcatgtcctttttgttgaaagtgatttcctgagtcggcagcattttgttgtgctgatagtttgtttttgtttcaaacgtgtactttttatctttggcggaatagacggcgtctttgtcatgctgcacgtcctttacaagtgactcaaacaaatatacttggctgctgttattcggccagtcgctttggaatctgaagctcttatttaacgacggcgtgaggacaaagactccgttggcgttccgtaaaatgacttggttttggtcttttttcggattttccagatagacccggtacagggaaggttttttatgccagatttccacattgtatacttgcggatcactccccgtttcgatggtcattttggctttcgctttgtacgaggtgtattctttcgccttcttatctaaaccgttcacgatatcttcctgtgatttttggccgcaggccgaaagaataaggacggcaagcagtcccgttaaaagcaaaacaaagctttttctcaccttttttcaaccccttcttctcaattgatgtaaagggaagaaatcgcttgtttgactttaacggtacgccctgaacggacggacgcgtaccataaaagcctcaaacaacttgtctcccttaatgcactatcaaatatatgaaggggttccggctaatatgcagactagcgtgacaacctttcaatcacgacctgtgccgcggcgtattcttttgtatgggtaatggagacgtgaaccgccgcgccgtcaagcttggcgcaggccagcacaggctttcccgctttgtcgtttccagtttcaatatcctgaaagctgagctctttgccgatacctgtgccgtatgctttcgaaaaggcttcttttgccgcaaatcttcccgcgagaaattcaattttccttttgtccgacagcaatgtaaaacgggcgtattcagcctccgtcaatattctttgcggaaatcttgcctgccggctgagcatgttttcaattctgtgcagttcaacgatgtcgattccgattccgaaaatcatgtgaattcctcctaaaagtccgtactaaaaaacggtttatgtcataaacgtgttactatatatgtaacaaatcagatgcaaaggggcttgcgatgtttatacgaacggaaaatttccagacttttatcagacgttatccggccgtcagctgtatcttggcactgcaggcgttcttgtggctgtttttcagtatgccgcttcattccgtcatgatgtggtcagatgctgtgaccggctataattacggcgtttcctcgggagaatggtggcggctggtgacaccgatgtttttacacgcgaatttcactcaccttttgtttaactccatgtctctctttttattcgcgcccccgcttgagcagatgctcggaaaagtccgttttctgattgtgtacatcgcatcgggcatcatcggcaatatcggcacgtatcttgccgaaccgcttgattatgtgcatgtcggcgcatccggcgcgatcttcggacttttcggcgtgtatgtgtttttgactgttttccgcaaggagctgatcggccgggatcagtcgaaaatgattatgaccctgcttatcatcgcggtgctgtcgacgtttatcaactctaatattaacattatggcgcatttgttcggactggcaggcggatttttgctttcctttttatgcgtgcagcaaaaaaagcggcggtattaaccgtccgctttttcatatgaataccagcgcccgatgcgttcggcatcttcctcgctgacatccttcagcatgacatgctccatgtggtgagctgatttcactgcggtagccacagatgcgagccgccttcttttttgcagaaaggagcggctgacttcaaacatctgcattcttcttctcagcataatcgtggtcgtcttcccgaccagcctcgtggtgatctgaagcctgccgccgtttatgcaccatgacgctgtcctaaacgaggcatatccaagcaccagttcgacgggaagcacaaggagcgatgcatatccccacggtttaaacagaatacaaagcgggatgatcacgaaaaccgagaagattatggatcggaataaataccggcgcagcgcccttttcggcaaatgatttcggttttcttccagcacgtaatccggtgtgaaaccgttcagcatcactccgagctttgatttgcggatgatcggaaacagaatcgtctgagctccttctttctcattccccgcactgccggcgctgacaatcgccaccgtcgcgtatccgaataattgcctgatcacattttctttcattttaatggcttggattttacggagcgggattgtcacttgatgtttttcaataattcctctggtaatgaccaattcgtgttcctttttttctatcttaaagttggcatgcttgatcatcataccggcgatgcttaacagccaggcgatgaacaatcctatgaaaatgatcacggcgtatataccgatgctcgcatgcttgagaaaagaaaacctgtcatagagccagtccatcggaagtacttcatcaatctgagaaaagagggcgaataccgctgagatgatgacaccgattcccccggatgttgaggcggccataagcagctcacctacagacagtcggtaaacggattgcacatcttccccgcgcatcggctcctgctccgctgcggtctcccctcgttctttttgctccgctttttgctgaaaaacagccgctctgatccgttccgcctcttccacagtaatggcggataagacggcctcggcgtttttcccgtcgccggccgtttcgatttgaagcttaacaagcttaaaaagctgctgaatgatgccggcactcgtattcattgattgaatccggtcaatggagatgtatctctttttcgtaaaaaacaagccttcttcaattctgaattctccgtcctcaatccggtatgtaaattttctccactcgatcacactagccgtaatcagccagataagcaggacggcgagcgcaatgcctccgtaaaagcggatgaagtggttggagtttacaatatagacgagaaaaaatggcagaataatgtttttaatggtttcgataataatatggaataagttcaaaatcacggccgccgggtgcagacgtttcggctcagacatcatcttccgtcacccttgccagacgggaaatggaatccctcagccggtcagcttcctccatatcaagcgccggaatggaatgaacggttgccgccgtggagattttgactgaggccagacggtaccttctgaggagcgggccttgtgaagtatctacgtgctgcaccctcaccatcggcacaatgacccgtttgacaataaaaatgccggattgaatatcaatttcattttcatggacttcatagcgccagatcctgtgcctgattttcggtatggcatagacggatatcactgaaccgaatatccaaatgatgccgaggactccggtgatccaatacggccaatggaagaaatggcttaaaacagctgctgctataacggccagaagacagaaggcggacaggatgatttcctgaagacgccagacttttaagccgcttggactgattcgattttttggctgtgctctcaacatacctacctcccattttttatcatacatacaaatacggctgatttgcaaaaaagattcactttccggcatatcaaaaaaaagcggaccccgtacaagggtccgcttcctgtgttttagtatgattttttctggcgtctgtcacctgaagaacggcggtcgcttgagcgttttttatcgtaggaagaacggttgttggttttccctttgccgccgcggtagccgccgccttggccgtctctgcgcttagaagtacgctggtttttatagcgtttgctgaccatcggcgcttcatcagtgaggcgtacaggcgtgctgtccggctcttttgtcgccattttaatggctgcagccacaactgtcactgcatcatgatcttctaacaattccgcagctgccgtcatgtagaagttcaggttgttttcgctgatcgccgtgcgcagacggtcaaccgtcacctgctgctgtccttctaatgcttcgtcaagcgtcggctctttcatacggtccattttgcgttttgtcgtttgttcaatcgcgcgaagcatgcttttctcacgcggtgtgataaacgtcatcgccatacccgtttttcctgcacgccccgttcttccgatacggtgaacgtagctttcaggatcttgaggcacgtcaaagttgtaaacgtgggtaacgcctgagatatcaagtccgcgggcggcaacgtcagtcgctacaagcacttcgatcgcaccttctttaaatttacgaagcgcaaccatacgtttcgcctgcgttaagtcgccgtgaattccttcagccgcatatccgcgaaggttcagggcttcagcaagctcatcgacacggcgtttcgtacgtccgaatacgatcgcaagttccggagactgaatgtcaagaagacgagtcagcgtatcgaattttttgcgttcctgcacttccaagtagaactgctgaatgtttgatacagtcatttctttcgcttttacttttacgtgttccggctcagtcatgaaacgctctgcgatccgtttgatcggcgcaggcattgttgctgagaataagagcgtttggtgctcgctcggcacgtttgagagaatggattcaatatcatcaatgaatcccatgttcagcatttcatcagcctcatccataacaaccgtattcacgttgtttaaacggatcgtgcggcggttgatatggtcaagaagacgccccggcgtacctacgatgatatgcgggtttttctttaatgcgcggatctgacgtccgatatcctgtccaccataaataggcagtactttcgcacgcttatcttgtccgattttatataactcttcagatacttgaatggctaattcacgggttggcgcgattacgattgcttgaatattaggagactcggggttcattttttcaacaaggggtataccaaacgcagctgttttacctgtacctgtttgcgcttgtccaatgacgtctttatttgaaagtccgagcggaatcgtttgtgcctgaatcggcgttgcttcttcaaatcccatacgattaattgccttcatgagatcagaacttaattgaaaatcttgaaacgttatagtcaaattattcaaactccttctaattgctgtttcagtaatgtcgtgatttaccactaaaaactgtcctttcattcaaaagacaggatcgtacgtatacaaagcccgaattactttacgtttaatcttaccattacagtatgtgtttttcaataaggcgagatggtcaggcggccggaagcggcctgaccggattcttcccgcgaatgatgccggcccccgcaccgtgcgggttttcccagccggcgggatttctttttcatacggacagaattatttcaccctgaattagtttcttcatttttgataattttataatgctgatcggtattttttcagttcttctctaataaatctttaacgatttcttcgagcttcatacctcttgatgctttaaacagcaggagatcgccggaagcggcacttttctgtatcgcgtgaagcagttcttttttgtcaagataatggctgacgcgcccttcttcaaaatgccggcgcgctccgtcagcgatgaatgcgccgagtgtgccgtaagtaaatacatgatcgatttccgccggattgatcgcggccccgcattcttcgtggaatgctttttcattatccccgagttcaagcatatcaccgagcacgagcattttcttccgatagcctttcatcgtttcgattaattcgaccgccgctttcattgacgtcgggctcgcattatacgcgtcgtttacgattgagatgccgttttccgttttgaccagttccaatctcatacccgtcaccttcaggcggctcagtcccagagcggcattttccggcgtaatgccgaaatagatgccggcggcgtatgcggccatggcattcatcacattatgtctgccgagaacgggaataaagaaagaacggtcgattccgtcgatattgaagtacgtgccttcttccgcctgttttattcctttcaggcggagatcattgtccgcgcctgcgccgtatgtcgttgtccggcaagtgtacgtcttttcgcgaagcagcggctcatccccgaaataaaacagaacgccgtcttcccgaagtccgtttataatttcaagtttcgcctccgcaattccttctcttgagcctaaatcctgcatgtgggattcgccgatattggtaatgacggcagcttccggttcagcaagacggctcagaaaatcaatttcgcctctcgcgctcattcccatttctaaaacggcgatttctgtatcttcaggcatggcaagcacagtcagcggcaggccgatatgattgttgaaattgccggcggttttgtgaacgcggtactgcgtgccgagaacggcgtgaagcatgtctttcgttgtcgtttttccgttgctcccggtcaccccgataacccgtgtgccgagctcttccaaataagcttttgccaatgtctgcagcgcctccagcgtgtcatcgaccaagatgacagcacgctcctccggcggattcgattcggagcgttcccacaacaccgcggaaacgcctttttcgaatgcttgcggcacaaaggtgtggccgttaaaatgctcgccttttaaaggaatgaacagctgatttttttccaaagtccgcgtatccgttgcggcgccctcaatcattgtttgttcaaatacgggatttgtcagtgtgcctttgaccatgtctgcgattcgttttacagttcgctttatcaaaggtggcacctcgctttctgaaaatgttgtctgttacgggaaaagacactgccccttcaggcagtgtccgtcttcattaaaatgtatgtttaatcagctgtttttcggcatggcgttcttttgccagctcaaccagctgttcgatcagatcactgtactctacgcctgcttctttccaaagcagcgggaacatgctgaatggcgtaaagcccggcattgtgttcacttcgttaatgagcacttgaccgtcattggtcaggaagaaatcggcgcggacaaggcctgatccgtcaatcgctttgaaggctttaatcgccatctcgctgatttccgcatattgttcatccgtcacttgcgcgggaatcattaaatccgtgtcgccgtcttcatatttcgctttgtaatcgtaaaagtcggttttcggcgcgatttcaccgacggcggagcatttcggttcgtcatttccgagtacgccgatttcaatttctcttccggcgattccttcttccaccacaattttccggtcatactcaaaagccagttcgaaggctttttcaagctcttcacggtttcggcatttgctgattccgacgcttgatccgaggttcgccggtttgacgaagcacggatatcccagttcttcttcaacctgctgtaagcagctgtccggcgtctgtttccagtccttttttaagaaagcggcgtacttcgcctgcggaagccccgcttgagcgaacaaatgcttcatgatgactttatccatgccggctgatgatgcaagcacgccgttgccgacataaggaacgttcagcaattccagcagaccctgaatggtgccgtcttcaccgttcggtccgtgcagaagcggaaatacgacatcgatcggcgccttttcgtcagtcgacgcttcaggaaacatttcccggttcaatgctgatagagcgaaattttcaccgttttgttccagctgaagcattttcacgttggaaaccggctcagtcagcagcgggcctctttgccattctcctttttcagtgatgtaaatcggatgtatatcaaacttctcagtattaagcgcttttgttacagctaatgctgtctgcagcgatacattgtgttcggctgactttccgccgtacaccaatcctagacttgttttcaatggatattccccccacaacaattcatctttactatcttatcactttcctcagaaaatgatctaattatttttgggcattctgaatatgaaagcatttgtatgtaattcctttttattttatattaaaatggcatggaaaaggagatgtgtcatatgaaaaaaatcagtacaacagaacaatttaatgaacttattcaatccgacaaggaaatcatcgtgaaatttttcgctgactggtgccctgactgcacgcgcatgaatatgttcatcggcgatattttggaagaatataatcaaaatgattggtatgaactgaacagagacgagctccctgagcttgccgacaaatatcaggttatgggcattccgagccttctgatctttaaaaacggggaaaagaaagcgcatcttcacagcgcaaacgcgaaaacgcccgaagaagtcacagagtttttatcacagcatatttaattcgtttcacgatctttgtttatgacttcaggctctacatgaacatggacatgagtcacatcatgttcatgttttattgcatattcgacctcatcggctacttcatggccttctttcacagacagtcccggatctaccgtaatgaccagttccacatgaaccgtgctccccaaataccttgctttcacatccttcagcctgctgacctcttttatttctttcaccgtgtgtttatacggctccaaatctttcagatcaaacccgtccgtcaatgagtgggaagcatctttgaagatgtcccatgccgtcttacagatgatgattccgatcagaaaagcaatgaccggatcaacccacggcagatgaagccgggcggttaagacgcctataaacgccccaatactgacataggcgtcagaacggctgtctttcgccgccgcatgaagcgcagaacttttaacccgatccgcaagacggctgttatatacatacatgccgtacattacaatcgcgcttccgagcgccgtccatgccgcaatgaagctcggctcggcctccgttccgctgacaatcgcctttgctcctccgatcagcacttcaataccgaccgccatcataataaaagacgcaattaatgaagaaattgtttcagcccgataatgtccgtaggcatgatcactgtccgcggggcgctgggaaatccggagcccgatcagcacagccagtgatgcgacaatatccgtggcattatttaacccgtccgctctgagcgcttcggaatgataaataagaccgatcaccagtttgacggcggcaaggatgaggtacgcggcgatattaagaatcgcgcctttttcgccccgttttaagtttgccgtttgatcattcatgtaaggactcctccattctcattcatagtatggatggaaaagcggaaaaatagcagctttgatctgagcaagtgcaatattcgacagcattattccccgggaaactttttgtcgaaaaattggcggtattttccctttacatatgaatatgcccattgtatactttcattaactgataatgattctcaatatcatttgattaggagggtaatcatgaggtcttctcctcagctcagatcatcagttgaaggacgaaaaaaacatctgatccatttgctgatcaataacggaatatacaaaaagtcggaacggcatttatatgaattatcgctcggagaattagaaagcgaatacaaatatgtaaggaaggtgcgggctcatggcgaaacgtaaaataaaaacatacgaacagctgataaaagaaaacaaggcggccattatgaataatcaaaagctgatgaatgtgatctatgacagaattgaccgcaagcatcaaaaactgctccggcacaacagccatacataaaaagagcctttttcaggctcttttttttattgctcaaaggcttccgccgctaatttgccgatgaccgcatcgtccatcggcggattgtgaaggccggcccgggcatcccgataataccgctgaagcggattgtttcgctccaggctttttgcgccggtgattctcattgctttatcaacaacagaaaggaccgcatttgtcacaatatgttttgcggcgccaagctcgcttttgatgaaaggacggcgtttcgggtcatcatacatttgcgccgccgtgaagagaaactgtctcgcttttaacaattcaagctccatttccccgacacgctgcccaacggccggcacgtctttaatcggtccgttcaggctgttcggcgaatattcggatgcaaaccggacggcatagtcccttgccgcttgagcgatgcccagataagcagcgggaatgtgaagcagccagccattcactttcgccgctctcggcccgctgataagctccacaagccgctcgtcactgaccgtgacatgatctaaaaggagatcatggcttccggtcgccttcatggcaatcatatcccatgtttcttcgactgaaacgcctgactgatctttatgaatgagaaaaacaccggtcgtttgtttttcttcaatccatgccgtcacaagcatataatccaaagtcagtgaaagggttgtaaaggtttttcggccgttcagcacccattttccgtcttttttgacagcggaggtgccgggtcttcctcccctcgtcggactgccggtctgccgttccgtcgctgccctgttcaggacagctccctttttcacctcttctgtgataaatgaaaagacatcttcatcccagctgtttccttctccgagctcacccatgacggataaatgccagccgattccgagagcaacggccgcgtctccccgcgccatccgttcctgaaacagcaccatatcataaacggaaatgcctgcaccgccgaatacctcaggtaccgttaacgccgtatatcccgcgtcgcgcagtctttgaattttctccgcgggaaaacggcccgcctcatcatcaagcgcggctgttttttgaaattcgtctgcaagcaggccgattttttccatccattccctctgccgttcattctgtatccataaagacactggaatccccccattataattccgataaagttaataagtattatagagattcaagtctcgtttcgcaactgtgaggctgtacaaaaaaacacgctattccatggaatagcgcgttcagactgcttccgggccgcggtcctgcttaagcccgagataaatcagcatatatgtgagataacccatcgtcatcacaagcccgccaaagaaaaagcttgaaaaaatcggctcttcaaacgcggtaactgccgcaagcacgatccagcttgcatacaggtagatgatgaaataacggaatcccgacttcattttatataagagaaacagccccactgtagaaaacaaacccagcgcaagcctgaaataaacaagatgttcgaattggaacatgaatgacacaaaggaaaaaccaagcaataacacaatcggtaatgcggtaataaaatttctcaagtgagcacctccgtcattacctttattataaatcaaaatagcataaattattgatttatcgtgatctttttcacaaaaatgtcattcctttactttatacccgaacatcgcgtttgcaaaagctccaccaagcgacggctaagaagaatacgatatggataatgataatgcctgcggaaaataacggcgtcattcccgcaaacagcggtttcgccccgctcatatattgcgtcaggtcagtatttgcgaacagcagaaaacttccccatttgttttggaagagcgacataatcgtcacgagtgattttgcgccgtacagcacgataaatgacaaaatgacggccgttgcgctgtttcggaatacagaagaacacaacaagccaaagcatgccatcgcaaacgcctcgacccagttcgtgccgattactttcagggtgttcataagaagcgtccctgattcagatgtcaccgacacgccgaagaaagccatgccgaacagcagagacagaatatagtacgccgcatacaggtacaagctgaccaaaaatacggtaatgagtttagatacaaaaatccgctcccgctttaccgggcggattaacaaaaatttgatcgttttcttatcaaattcagcggaaatgatcgttgccgcgatcacgattgttaacgcctcaagcagaatattcagcccgggcgcgtacgccatatagccgatgaaattctcatccgttccggaactgatgacaagccgtttaatgacaagcgccataataaattggagaacggccatcagaatcagtgccactaatgagacttttcggttaaagagtttcatatgctcattcgctgtcaatttaaacattcgtctccccctcctcttgaagcgccgtcgtcactttcatgaattcatcctccagcgattccgcatacggcatgatggaatacacgagaaagtcttgtccgacgagcgcacggtttaatgccgggatgtccttcttcgctacggtgacggtaatgcccccgccgtttttctccggagcaaattgctgctgggacagccattcgaatgcttcgtcagccggctgaatgtcgaggacggctttttcttctttttcctcagcgccgcgcagaacaacctctgttttgatctcacctttttgaatgatgatgacacggtcgcaaagatcctccacttcacgcaataaatgcgtcgcaaaaaggatgctcgtcccttcaagctccgcgagttcctttaagtgatcgcggaaatccttcattccgccgggatcaagcccgtttgtcggttcatctaaaatgagcagattcggacggtgaagaatggcctgcgcaatcccgagacgctgacgcatgccaagggaatacgttttaactttgtcatgaacggcattggtgagcccgacccgctcgatgacttcctgaagcctgtcctctttgatgtttttgtgcatgttggcaaagtgcttcagattttcccaccccgtcaggtacgggtagaattcaggattttccacgatcgctccgacggattcaagcgctttttcgaaatcagcatcgtgctgaaagccgttaattgtaatcgtgccgctgtttttctttaaaagaccgacgatgattcggataagtgtggtttttcccgacccgttcggaccgagcaaaccgatgatctcgccctgcctgacatccatgctgatgttttttaaaatgtgctttttgcctattgttttgtcaaggccttcaatatgtaaaatcggctcagtcatacagccttcctcctttttcacaaaaaataaacagtgcccgtacataggcactgtctgcattataacattagtcatatattcgtgaagagccggagccgacgttatgtcttatccgggaccggtccatttttttccttctcttcattattgacgacatccagaatatcgagcaggaacacaaaaatcggaattccgataatcaagccccaaatgccgaagaaatgttccgagaaaatcagaactgtaaaggtaaaaaagatcggcagttccgttttcgctgacatcagtttcggattaaggaagtacgtctcaatcgcatggatgacgaaaatgaccagcacgatgtagatgacatacgctgcgccgcccgtcgtatacgcgatgatgctgagcggaatgagcgaaatcaccacacccgcaacgggaatgagcccgaggaaaaagaccatgatggacaggccgaacagctgcggaaaatgcagaatcgccaatgcgatcaaggtgaggatacagttcaccagcgcgataataaattgggcttcaagcactttgccgaatgttctcgcaaacttgctgccgaaataagcaagttcgtagtaaaaaacagacagcttgctgtgctgaaattttttcataaactccgtgagccgctttttctcgaacaggaaaaacatgctgagaatcagtgacatcacgacctgcaaaccgaaagtgctgatatcggccaagtatgtatacagtacattaaagccttcttttacataggaaccgatattgatatcgccgaacacgctcgatatctcatcataaaacggaatgacatcgggatgatacgcgatgtgcttgatctgcttaatcagctgttcaatctgcttggcaacaatcgggtaaaagacaaagccaccgacagtcgccccgacagccagcgcaatatataaaacggtgatgaccaccctctggctgatccggaaaaaatggttcaacacgtgccggatgacagtctccagccgatccatcagaaaagtaaaaataaacgtaagcaaaatcaaattaatcatacttcggaatacaactaacaccccagtcaaaacaagaaaaacggaaaaacgtctgacacccggatgctgaaaaaatttaaaaatagccgccatttatacactcctgctaggacaaaaagcccttagatttcatctttcactctctaattgtaaattatataacaaaatgacgctaaggtctttgtccacctcctaataaatttaaacaaatttatcttttttactcatggcggccgaaaaaaagaacggcatgcccgatgcatgccgttcctttccttttataccgccgttttcatttctttaacggcctgtgtgcttttcacttcgtcaaactcattttcgctcttggctacgatgatggtggcgattccgtttccgatcaggttgacgatcgcccttccttcactcataaagcggtcgacgccgaggagcagcgccagcccctccagcggaataacctgaagcgccgataaagtggaggcgagcacgataaatccgcttccggttacgcccgccgcgccttttgatgtcagcatcagcacgagaatgatcgtaacctgctggccgatggtaaggtcaacgccgaacacctgcgccagaaaaaccgtcgccatggacagataaatcgaggtgccgtccaggttaaaagaatatcccgtcggaatgacaaggccgacaaccgatttggaacagccgtagcgctccattttatccatcatccgcggaaggacggactcagaagagcttgtgccgagaacgatgagcagttcatctttaataaaacggagatagttccacaagctgaaaccgaatagtttgcaaatgatattcaaagcgacaaatacaaacaggaacatcgtaacgtatacagacagcatcagactcgccagcggcttgatggaatcaaggccgaagtgtccgatcgtataggccatggccccgaatgcgccgatcggcgccgcgcgcatgatgtagccgatgattttgaaaaaaacatgcgacagtttatcaaagaaatcaataatgcttttgcctctttcaccgagcgccgccaggccgacaccgaataaaacagaaaagaataagacctgaagaatgtcgccttttgcgaaagcgtcaaccatatttgacggaacgatgtgagtgataaattcaatccagtcaatcccctgtcccccgttttgcgtgtactgagagacatcccctttttcaagcttgctgtaatcaagcccctcaccgggtttcatgatattgacgaccagaagtccgataataagggcgatggtggtcacgacttcaaaataaataaatgcttttcccccgactttgccgacttttttcatgtctcccatcttggcgatgccaagcacgatcgtcaggaatatgatcggtgcgataatcatttttaccgcattgataaatgtatcgccgagcggcttcatctgcttcccggcctcaggccatacgagtccgacaatgacgccgatgataaccgccgtgatgacctgcaccgtaagatttttgaaaattttcatccctactcccccttgcctctcgctgcgtctatacaaaaatgatagcgttttcaaacgaagaggggaagcttatgatcataacggacattttggtctttttggtctcggctagcggacgaatttgtagcggttaaccggccggcccactcccccgtattgaatgtcgagcttaatctggccgtctttttcaagaaaatcaagataacgccgcgctgtcaccctggcgattccgagcgctttggcggcttcttcagctgaaagcggctccgtctgctgtttcatataggtcaaaatttcattcatcgtaaaatgatttaaccccttcggcagatcgcgggacggattttgcggaattttaagcagcatgtcaagctgctcttgcgacatggtgtcatgctcttcaattttccgtttatattgtttatagttttcgagcgcctgtctcatccgctccagcttaaacggcttcaaaatatagtcggccgcaccgttttgcagcataagctggattgtttctttgtcttttgcagccgagacgatgatgacgtctacttcgagcttttgttttctgatttcctggagcgttttaattccgtcttttttcggcatgtatacgtctaataccacgagcccgggccgcagatcttttataagcctgattccctcgtctccgtcagcggctgtggcgatgacgctgaaccctgaaacaccggtgataaattctttattcacctcctgcaccatcggatcatcttcaataagcagcaccttgatgtccatcgaatgattcctcccccttcatcggaaataaaatagaaaatgccgttccctgtccctgccgtgtgtcgacttcaataacgcccatccctttgtcgacgatttgtttgacgaggtacaagccgtatcccgttcctcccgttttattgacggtaaaccctttgtcataaaggtgcgggatgtgctgatcggaaatcccgcttccgttgtcttctattaatatagcaagcacttcatcattttgctcgatactgatgtcaatatgtttgtcctccgtgtccgctgtttcgaatgcgccgaacgcattttcaattaaattgccgagcaggacgacgatgtcatgctggtcgacatgctccggaaatgccgagaaactgctgttttcatcaattttcacagaaatgccaagctcttttcctcttttgattttgcttaacagcagccccgccgcagcgtcattctgaatggcctgatgaagaaaatcggtgacactttcttgttctgatgattccttaaaagcaagctggagcgctttttctgattttccgagctgaatcagtcccgcgatggtgtgaagcttgttcatatgttcatgattttgaactctgagcgcatcgacaaaatttttcacacctgtcagttcttccgccattttcgccgcttccgtcctgtcctgaaaaatggcgacggctccgatgaccttctttttcatgacgatcggaattctgctgctcataatcacctttccgctgacttggatttcttcattatataccgctcggttccgctcgacgatttcagggaggcgggaatcttttaacacgtcccagatcagcctgccgtctgtttcttgtctgacattgaatatctgcttcgctttttcattaaaaatggtgatgtgatgctgattatcaatcgcgatgacgccctcattcattgaatgaaacgtagcggtccgttcctcatacattctcacgatctcatggggctccagccaaaacatttgttttttgatgtggcgggccagcaaaaaggagccggccagtccgaacccgagcgccagcagaacgataaacagtatttcatgtttcagctgaagaagaatttcaccgaatccgggcagcgttttaccggccagaacgacgccgatctgattcaaatcccggtctttgatgggataaaaagcgcggacggcggtgccgatttctccctttgcttcggaaaaataaatgtgctcggcgaacgccgcggcttcgtcctcaccccttgaacgctttccgatcattgtgctgacgggatgtgaatagcggatatgatccatatccatgacgacgatgtagtccgcttcattgatgatccttatttcttcgaccgcatggcgcacgtcttccctttgttttttctgctcgagggcgcgtttgacatcggtcatctcagataccgtccgcgcggtattcatcagccgttttttcagctcgcgctcctctgtatgctgaatattgccgatcagcacgatgccgacgatcaaaaaggtaaaaagcacgacgatatacgaaagtatggtgattttccagcggatggtgagcttttttttcgtcattggcctcttcctttccgtctctttacgaaaacggcccgcccgattatgcttgttatagaaaatggcggagggggttttcgatgaaaagcttgctgacttgtctcagcctgatggtactcggtatcggaaccgctttattcatcggctttcatgatcgtttctcaacggaagaaccgtattatgatgacgaacaggaaggcctgaaagatcaaatcgttttcaaattcagccatgtcgttgctgaaaacacgccaaaagggcgggcggcgaataagtttgccgacctggtctatcaaaagtccggcggcaccattaaagtagaggtgtttccaaacgggagcctctattcagataatgaagaaataaacgccctccaaaacggggacgtgcaattcatcgctccctccacctcaaagctcggatcactgtctcccgaatggggtgttttggatctgccttacgcgtttacaaactataaagccgtgcaagaaggcctgaacggcaaaatcggcacacgcctgttcgcttctttagaaaagcatcatttgaaaggtctggcgtactggacgaacgggtttaagcagcttacgtcaaataaagggccgatcttcactccggacgatttgaaaggacaggcgctcaggatcatgccgagcagcgtgatcgaagaccagtaccgtctgctcggcgcgcgcccgcggcaggattcctttaattccacgtttcagctattggaaagcaatctcgtagacggagaagaaaatacgatttcaaatatctattctaaaaaattttataatgttcaacattatttgacaatcagcaatcacgggtacctcggttatgccgtgatgaccgacgagcatttctggaattcgcagacagaaaaaacgagaaccatcttaacggaggcgatgagagaaacgacggagtggaacgaagcctccgctgagaaaatgaataaagaccagcttgaagagataaagaagaattcatccattcatattcatgtgctgagcaaagcggaaaagaacacatggatgaaacgcctcgacccgatttacggacaatatgaacaggtgatcggccgcgggcttgtgcaggatttgttatccttgcgccgcgagccttagcaggaccaatacgcccatctccgtttcatcccttttcccgccggggaagtaaatagggacagagcaaaaaaaggagatggagacatgtttacacatacgaaaaaactgcagcatccggctaaaccggatcgtcctgacccgctgttcgcaaaaaagatgcaggaaattttagggggacaatacggggaaatatccgtcgccatgcaatatttgttccaaggatggaatacacggggcaatgaaaaatataaggatcttctgatggataccgcgacggaagaaatcggccatgtcgaaatgatcgcgacgatgattgcgagactgttagaagacgccccgctggcagagcaggaaaaagcggctgatgatccggtcatcgggtccattttaggcgggatgaatccgcatcatgcaattgtctcaggactcggcgcaatgccggagagcagcacgggcgttccgtggagcgcaggctatatcgtcgcaagcggaaaccttctggcagacttccgcgccaatctgaacgccgaatcacaaggaaggcttcaagtcgcacgcctgtatgaaatgaccgatgataaaggcgtgaaagatatgctcagctttttattggcccgcgataccatgcatcaaaaccaatggcttgcggccattaaagaattagaagaacaggaaggcccgatcgttccttccacattcccgaaggcactggaaaaacagtcattctcccataagcttattcatttctcagatggcggagaaagcgctgaacaaaattggctgaaggaaacagcgccggacggagaaccatttgaatacgaaaaggaaccgaaagcgcacggcgaaatagctaagctggatcctgtcccgccgtatgtccacaacacgcttcccggacgcgagtaaagacacaagcccaaaacaaactgttttgggctttcattatgccttctgaaccgtccagtccggttcgtatcggatgtccgggtgatgtaacagctcgtgaatgacaggttcatcctcttcatacagcatcacttctattgaaagaatcgctgccttctgctcgttttcttcgtatatgcggtcatgttcgttctccataaaatcatcataggcctgtctgttctcccaaacgctgatgatctctgcgatgaacaggccgtctgcgtttttccgccacccgccggcctgtttgacgaagccatttacacatgataatgctccccaccttgactgtgcttgcgcaaatgcttcagcgtttgcagcgtctgtttcacatacaatttttttgatcagcatgacgttcctctgtgatgactgttttcgcacgcgtatgctcaacacacagattcacggttctgacgtaagagcgggtgcggtgaatcgtgcctttcgggatgagcaggctgtcatttgctttgagcactgcggtttctttgtccttaaaatcgatcagcagctccccttccagaacgatgaaccattcatctgagtcagggtgatggtgccagtcatattctcccgtaaacactgcgaggcgcacacagtggtcattgatctccgcgattgaaaaattgtcgtgtttttctttgactttattggcgatagcgagcaaattcagcatgtcagacacgagtgaaaaacccctttttcatttattgtatcgcaacggcggctcagatcaagattttcccaaaataaaaagcgatccagctgatgcgccggatcgcttttgatctgcaggttgtctgccttttatgcttttattagctgcttcgtctgtttccgcctttttggccgatttccttataaaaatctttgtcatgatttttgctagtggcttctccgcctttttggccgatttcttgatagaattccttgtcatggttattgctagtggcttctccgcctttttcaccgatttcctgatagaattctttgtcgtgatttttgcttgtggcttctccgcctttttcaccgatttcctgatagaattctttgtcgtgatttttgcttgtggcttctccgcctttttgaccaatttcctgatagaattctttgtcatggttattacttgtcgcttctccgccttttttacctgcttcttctctgctcattttgttattatcttgtgccatttttgaattcctcctttaattggtgttggttgttggtttcccgatttcagaactgctaaacaaagaaaacacattgaatgtgttcgggtggttttttatcattctgtatccttcatgcgttttagaatccggcgttttttataaagcatgatgcctgtttccgcgatgctttctaaagctgaacggttggcggacgcgccgaagatgatgcctgcggccggaaccatttgcagcagttttttcgcggcgaacgtatcgcgatagctgtaaacgacttcccgccagccttggatttgcgaggcgacgcgctgataggcgcggtcgttttgatcatattgccgtaaatcttgcaggatcgctttttttccgatgacgtcactggatgcaagctgtagcaatttgacgataaacacgcgttcttttttgtctttcggatcaaagccgtaagcaaccgcgatatcctgcagcgtctttaaggacaggccgagcatcgccggaatgtctgccgccagcgtgaatacgccgccgactcccgttgcggctccctgcaccttcgcggcctttacgcttgtacgcgctatggcttctgcgatttcgtccatgacggcaagcggcgcattgcggatgtcgtgaagcgtttgacatgtaccgtgcggcagccgtttttgaaactttttcatgatgcgcttttctgatgtcaggtactgtccgcctgactgaataaacgttcccgtttcatcgagaatgagtccgattttcctctgaataaattgcggtgtcagcttgtccaaaagctgaaacggcaagcgggtgaatgtttgccagaacatcaccctctgctgcgccttttcccatttttgaatgtctctcagttgtctttccaggtctgtccgctcttctgtcacccgtcctgcacgtcctttctgatttctttcttcatagtatacctttatggcgttttctttttacatccggacggattttttatccggaaaacatcccattgtttaatttccttcaaattctgtatattgtataattttgaataatacgattgaaggagaatgttgaatgcaatggatttatttaagtttagcgatcatttttgaagtattgggtacggtcagcatgaaattatcaaatggatttacaaaacttgtcccaagtattttattattattgttttatatcggcagcctttgttttcttactttgactttgaaatatataagtgtctccatcgcgtatgcggtctggtcgggaatggggatcgtgctgatttccgtgatcggaatttttttctttcatgaacagttctctgtcataaaagccgtctctgttcttctgatcatcatcggtgtcgtttccttaaactttatttctgaaagtgaaacgtcatcaaacggcatcagcgttcatacggacagaaacagatgatgaaagggttaaaggttctcttcctcattacagatattggatttatcgtttattggattgttactttttttgagtggattccaaaaaacatggtgtttaaagattatgataacgccatgatcatggcctggaactggtcattctttcccttagatattttcatttcgataaccgggctgtacagcttgtttctttataaacggaaacatgcgttatggcgctctttcgcattaatatcacttgtgctgaccttttgttcaggcctgcaagcgattgccttttgggtatttatcggtgattttgatcttatgtggtgggcattcaatctgtacttgcttctttatcctttatattttattcggaaattgctggtctctcgtaaaaatagctgtcattctttttgatgaggcggttttctttttcttcaggcgggaaacacttttcataaaggagtgatagacatgccttggtctatgaaggattatccgcaatcattgaagaatctcgaggaacctgtgaagaaaaaagcgatcgaaatcgcgaatgcgatggtagatgagggttatgaagaaggacgggctattcccattgcgacaagtcaggcgaaagagtggaaaaaaaacgcttctaaggaagaaatcgatcagctgatggaacacgatgatgaaacgaaacgcggaaattgaatcggaataaaggaaaaaccccgctctcaagagaacgaggtttttctgattataaaccgtaataataggataaagtggtgactgaaacgtagcctgtcgctcctgcatacgtgaccttcagccatttattggaattggtgtagtggccttgaacatattctccggttacccaagaacctgtaatttttttaccgcttgagaatgttgtgatcgttgaacagctgaccttagagcatgagcgcatattagcaccgtaaataccgactgtgcccccgctggctaaaatggaaacgtccggttcagctttaggtttgaaagctgctgctgatgcagagccgccaaaagcgaataaagaaacagcaaaaatcatggctaaagaaatgatcgacaaacgacgtaccaagaaaattccccctcttttatcatatggccggaaagctttcctgacgttattatactttttcgcccgggagactgaaataagtctaatgctccaacttcttttcttcgcaagtgaccatgccgattctttttttgatagataacagcggtttattagactggaatcactgaaatatcgttgattcaaacgtttattcagagcggccggagtttttccggaggtcatttgaatggtacagagaggttttatcttccaatggaaagaaacattattattctatttacccgggaaaacggaggaaatacagcgtctttttctcaaatcagttgggcggacagaaagttgtgaagttatataggcaagtgtcctcttttcacctttttaaaagaacgctccacgcatccgcgcatgatccgacgcggaaacacgctttgcgaacggcatcgcttctttcccggaacgatgccgttttcattttcggacctttcttcggcgggatacatatcatagataaaacagggcatcaatgtgccggtttattgaacataaagaacttgacatcttataatagcggatttatgatgtagataaaataatttgcgtctaggaaactttttgttatttagctaaaaatctatcggaatttaggtgagacataatgagcaaagacatctcagcacaatcactgcaagcaaaagccgtgcaggatgcacttgacggcaaaagcaagggattcaagcggcttctgccttttttaggccccgcctttatcgcggcgattgcctacattgatccgggaaacttcgctacgaatatctcagctggttcgaagtatgggtatatgctgctgtgggtcatcctcttttcaaacttgatggcttttttaattcaagttctttccgcgaagctcggcattgccacgggtaaaaaccttccggaaatcgccagagaccggtatccgaaatgggtatcagccgggctgtggatacagggtgaactggtgattatggcaactgatctggcagaatttatcggggcggcgctcggactcaacctgctgttcggcataccgatggttgaagcggccattatcgcggcgatcggatcattcgcgattttagagctgcagcgccggggttatcgggcgctggaagcgggcatcgccggacttctgttcgtcgtggtgatcgccttcgctctgcaaaccttctttgccaaacctgacgccgcctccgttctcgaggggctgtttatcccgaaaattgacggaatggacagtgtgctcttggcaaccgggatactcggcgcaaccgtgatgccgcatgccatttacttacattccgcactgacacagcgccgtgtcgtcggaaaaacggatagtgagcggaaaaagatttttagattcgagacgattgacattctcatcgcgatggtgatcgccggggcgattaacgcaagcatgctcatcgtcgctgccgcgcttttcttcaagaacgggctgtatgtagaagatttagacgtggcttatcagcaattcggccactatatcggaccggcttcagccattctcttcgggatcgggctgctggccgcagggctttcaagctcttctgtcggcacattgtcaggcgatattatcatgcagggcttcatccgttaccgtatcccgctttatttgcggcgtttcattaccatcattccgccgatgatcatcattatctcgggggtcaacgccacagaagcgctcgtatggagccaggtcgttctttcattcggcatctcctttgcgctcgtgccgctgattatgtttacaagcaacaaacgcctgatgggcgccctgacgaaccgaaaatgggtgacggctctcgcctggctgattgcggttttggtgatcgcgcttaatctgtttgtgatctacgattcattccgttagaaaaaaaccggccattgcggccggtttttcttttgacgccgggtgccgttcgtatctttttccgggcgtttttggtatgatagaagaaaaatcggagttttgcttatgtcagtatttatccttttttatctgtggattgtgccgattgtcatcggcatcttctgttctctttttgcttatcggacaacgggtaagaaacgtctgattcccggctttttgatgatcgcattaagcatcgtttccttaatcacggggctttggatcggcggggtgaactatcatgtgttcatcgggggcatgtttttattcggtacgttattggccggctccgccttcccgtttttcttcgctctttcacgcaaacgaaaataaacaggcatgccgcctgtttatttttattcattaaccctaaattataaaccgctccgataatgtgattccgcctcaatcagcctgtacatgtgttatataggctccagcccatgtcccatctcatcgaaactgcagccaaaatgaatcctactaaagaagattttgaattataagaaaaatactgtattaaaatcctatttaccccaaaaatacctattgatagaatggtatctgagaggggaaaatgttcaaagcggatcatatcggtcccgcctaaatacatagtctttcatttctctctacactacatttctaaaggaggatttcccattagacacgcagctaaaggcattctgtttgccgcatctttagcccttgtaactactgcttttgtccccgcatccttagctaaagaaaatcataataatactgccaatgccactggaacgaccaaatcatttttttatcagactgatacgcaattttcctacggacttaaagcacaaagcgatgcatctgtgtcaaaaccagtcaaagatgtaatcagagaagtgctgaaaaataaaacaaaattattcaatcttgttgaaaaattagcaggaaagaaaataagaaatgaactcgaatccgttttcaatgaacacatcgaaccggttttaaagaaaatgctgaacgagtatgtcgccttaagctgggctgacgtggaaaagaatctttatctttcacttaaaaagtccggactttctgacagccaggctaaaaacctcgctcaattgacaactttagcaatgaaagcattttaaaatcattcataaatgatcgtcaggaaaatacgtatgaagtaatgcaaagtgctgttagattcactctaatagcactttttcattggagatgtcacatgactgtcttttttactgttctgctcactttcttatgctgccttgtgatttcatctcttatttttatgattctattaaaaaaagagatcgtggatacaccgcccaaccgcttagctcatgcagcattcatcgtacttattggattctccctgttcttggctataactgtacccagcctagttatgtattttgcagctataactgtaaatcattttttcggagaatatatcatctatggttcactttcagacttatacatattttctgtcgtcgtaagtatcttagctttagtttatatgcttatccttacggcaattgtaaaaggaatgactcatgttttgacattgcctgcttggtcagcctatatccttgaattcatttttgcatgggctgctgtttacttctcaatccaatacgtttccaatcatatcattgagaacatatctatatttcaaggtggagaaattcttctttcattgttcatcactttcttattttcgggattggatatccttttcactaatttggataagatcacaaaagagaaattaggctaagggggtaacaaatatgagaatcatgacatatatatcctatttttctatttctttagttttgcaggtggtatggctgctattaataaaaagaacctctaatatatttctgatagatatgattacggtgtccttcttattcaccctctttatgttcatcttagatcaaatgttcaaaaataagcggacaaattagggactgttttttaataatcctcgggcttctctttcgttttgaaatgattccggatctagagatgttacggtgagccattcattaatgaataacaccagcctctttaaaatacttcttcttttatataacatcctgacttttccgtcatatattcatacgaaaaaactgcaatagggagtaatgaaacatgatattgtttattggcaagttcatgttgctctttttactctgttcgctggcgcattatttgtttaaaattgtttattacaatatagggaagaacattgcgcttaaaaccccgaaagggacaaagacaaaccggacggcacttgtgtttgtcaaaaatggaactacactgaatgagggagattactttatgatcgctgttgtgaccgctctctggctgttcttgagatgaattgcactggtccttcataagttttttgatcagccatcgctcgccagctgccgattttcacaatcatcgttttcgtttaggacggctatatgcaagcaagccgctcaacaaacaaaggagctgtcgagatcttctcgatagctcttttgtttgtccttgaatgattgaagataggcttaaaaatggacggcgtctttctcatgcatgcatcgttcaagaaaacacttcacagcaaaacggaaaggtgaacgcaatacaagtaacggttaagaaccttatgaggcagcgtatgttgattactggataagaaaaagaaatcccccagtcttaaaaggtggaggtcaaaaattggagaacacttaaatatttatagctttttcagcgatataaaaagttccagagtcactcatttcagcagtataaacatttgtcacacttaataatccagtaaaaagaataccgattaaagcggagctgattataagtttcttcattatatagcctccgtaaccttaagtatttgtgtttgggcatgtatggttttctttaaaaagtttcttccctctacatagtttctcttctcaaaatgaaagtcacctaatttttcggttagctctgcgaaatcagaccaaaggcgtttcttttccaagtaacctaagctttgtttcacttctgtttcattatattcttcttataatgaattaatgatttttaatttagccaaatattcttcttcattagaagtccgagcacgatttagagccgtttcataaaagaaacgtgcttccttggctttatcacattggtacaggacattcgccatcatatataatgatctcactccatacactgtatcaatatgttctttcacgtctattgcctttttgaaattctcttcagcagcaatcaaatttttccctcttaaataaactaagcctaagttatgaaagatcactccgataattcttttcactttttcctcatccaagccacgggcgatacttaatgcttcccgataatatgattctgcctccgtcagcctgtacatatcgtacatgttagcaccgaccatcatattacagccaatcactttcactttgtatagttgacttttttcaaacaattgcttggctttttttaaatgattgagggaaacaaagtgctgatcaatttgataataggcatcagctattttgtaatgaaattcagcttgctccatttcatctgatacagcattcaactctctctctgctttgcgataatagcttatcgcttcaacatactctttatgatcaaattcatacattccacgaaaaaacaatgagtaatatttcaagaggcctgtaagtcttttttgtggtttttctattttttcaagcagttcgtcgactgtagggcgatctctatatctgtcttccggctccaaggaatctaacatcaattggtgacgaaagcacatcaatgaataaaagacaagcaaatcctgatcctcttccatctcctctatttcctgttctacttcagcctttaaaatctcagcatcaggcacactgaactggcgaatcattttgtaccattcattgatcttgacaccaacttgggacgacggtaaaacttggtccacacttatccctccctctaatcactatttttgtaatattataacttttcctacaataaacacaaacgaaaaaatcccgcaattttcgtcgcgggatttttgggattatggttttgatgtacactcttgattattccatttaatattttcgctttgtaaaattcattatagtcttagtgattgaaccggagataaggcaggctcccgtcatgataaacacccaaattaaaaatgttggctctgcccctatcacaacaaacataaatatcaatgacaggatcaatacgacgacaaccatagtccatacttttttaaagatgaaataccctattatccccagcataaaagaagctgccggaagaataatgagtatgatatatgcagggctcaaaaacgggctaatataaacacctcctacttattttaaaatttcgaaccgggcaatttcccactctttttttgcttttagcgggattgtttttacctttttgcctgatttcaaatcataagacgtgatatctccaagcttgttatcacgctggatatcaaagtttttgagtaaaacatacatctctctgtcattgaattgaacatcattcattaatttgttatcatccccagcataaaaatcaaaagattttttcttaaccatttttttatcaaacacctgcagcttcccctcaaaagaaacagctaagatgctatcttttaatattttcaattttgcaggatgaaaccctttctccatctcgacttctttttttaccttaagagtctctctgtctattaatatgagcttagaattctctttctcattcacgttatcattaactgccagtacaaatgtattttcatctagagcttggaatgcatccttttcatccatgaagtatatccctttattcggtatggatgccttgttctcttgcttatttgtctctgggttaattgaaaggatggacatactttcttcatcacttgaaatgacataaattttatttttagcgacgattgctgatccaagttctccgtcaagctttatttgtttcttgttttttcggctgtttcccttccaatataccagttcactttccagccctttgtctgtatatccaacgttaatgtcatggatgatataaccgtcagaactatttataaagaaagcaccttcatcctcagttgtttttgacaaactcttttcatttattttgtttatttttccggttttattgtctatcatcaagtgattattgcttctatttgatgagaagaacgtatcgtttttgttatatgaagacatcgtgaaatttataccatctttcaattccaagctatccattttagcaccatcttcaccgtaaaccccaatctcacttcccctatctaaagtgttagaaaaaccaacaataaattttgcattgtcaatatcctttaatacagtctttttattgctgcttctttcctctttttcattcccagtttggatgagaccgcaagaggttgtgactatcagtatgcaaatgaaaataaacagggtcttaagtctattcatattttcctccctttgaaatgacaaaacaaccggtgcagcaccgattgtttttgtcaatttgtttaacccttgtgataaaagattgttgtgttattggattttacaagctccattggtgttacaacgctgtcccatttgacattgtcaatatcaataccttggtttttccaagaacgccaagctaattgagaacaataaaatttagcagttgtctttttatttaaaaagttgaaattatatttctttttattatctgcttgcttttccgcatattttgcagcgtttatatacttattgttattcgatcctttaacccatagaccataaactttctttttacttccccagttattattatatctgcgaactccatcttggtttatagggctccagcttttcgcccatgcttcaactgtttttgatttgttagttgaaacaaccgcagcatgtcctacaccaatagaccaacttccagaattaatttcatagcttgtaagaacatcaccttttgtacctaacgcttttgctgcaatttggttcttgggctgatattcaggctccttgtatttaggaagaacttcatcaatttgaccagaggctttcaattctttgatttctttttgggaacccttatacaagtcttctgcatgttcttgtacatacgcatactcttctttactcatttcatagaatttctgtacttcctcacttgtcatgccggcatctttcatttcctgtatttccgtttggactttttcattagtaagttgcggaaatccttcagcatgtgcacttttcccaaatcccaagcctaaaccggaaatcaacatagttgtagagaacatggtggtaagtaaaaatttactctttttcacgtcagtatccccctattgaatatttttccttcttttctaagatataggatataaataaggttgtaaacacctttttttaattatttaggatattttaatcatttctatctagtgcataatgacacaaaatcgggatatgcagtgccaactgaactataggatttgggttttgcacgatgtttatcaggcaatgtgttgtttcactatttcttcgtaaggttacccttcaaattttatacaaatttacaagtatttgaaatgccttccaacaaacacattctaccattgatgcgaaccacaattctatatacttctttatttttatgaaatatatagaattgtggtacagccctattaaagggctgtttcatttatttcagaagagacaacatttttgctttcgttttcggtccgtaaattccatcagcagttaacccgtacatagattggaatcgtttgactgcgtttgctgttttcggaccgtaatagccatctattccgttgttctttgctcctttgtccggatagtaataaagagccgccaaagctgtctggatctgtttcacggccgttcccttagttaaggggcttgtcactttaaaaacgcctgatggcagcgtgtaagatgattttttgccttttgttggagagctggccgagtccgtctgctttaatacttggccgactttgataaaattcgggtccttgatactgttcaacctttgcagggtcgccatgctcacgccagtttcctgtgcaatgacagaaagagtatcgcctttcttgacggtgtacgtcgccccgcctgtcttggtttctgtttttgctgataagggctgggcgatgcgatgtgcgaaccacgtttgttatgaactgtcctggtccttcataagttttttgatcagccatcgctcgccagctgtggcttttcacaatctccgttttcgtttaggacggctatatgcaagcaagccgcccaacaaaaaaataaacaggcatgctgcctgtttatttttttataaccacctgcttcttaaaacagccgttttaagcttttcttgagtgacggcatttcgattttttggttttcaaagaagtttttcagcatgtatttgctgaagcccttcgcttgaccgtaagtgatttttcccggaagcggcggctcgtcgccgatgacggcgtcgatgacgaccggctcatttgagttgagcgcttcatgaaaagcgggagccaattcctcgtgtttcgtcactttgatcccttttgccccgcagctttctgcaaaagcggcgtaatccatattttgcagctgggtgacgtagtcaatgttgcctttgacccgctgttcatattcaatcatgcctaaattttcgttgtttaatatgacaaccgtaatcggcagtttatatttaacagctgtcggcagatcctgcatcaccattgaaaatccgccgtctccgcaaatggcgatggactgccgctcaggttcggcaaggcttgcggcaatcgctcccggaagcccgcatcccatcgtggcgagccagcttgagacgataaagtcctgcttcttcattttaaaatggcgggccatccacaccgtaaccgttccgacatccactgacaggacggcgtcctctgcggccgcatcctgaagccgggcaatgacctgctgcggcttgagcggatgagtcgcttcggtttcatccttttcgatttccttccaccaatgcttcatgtgctcggtgcaggcgtccaaaaatcttctgtcttctttatattcaatgtattccgtcagctctttcagccccagagccgcatcactgacgattcccgcattgacgggatagcgcttgccgattttcgccggatccgaatcaagctgaatggcgggcgtatcatccgggagataatccctgtatgggaacgatgtgccgagcatgatcagcagatcgcattcctccattgcttcgtaggcgggctttgtgccgatttgcccgagattcccgagaaagtggggatggctgtcaggcacgacgccttttgccggaagggtaatgacaatcggagcggccgctttatcggcgaatgcgagcagctcctcttttgctgattttaacccttggccggcgagaatgaccggtttttttgcgttgttaatatattgcgcgcatgtcacgagatgttcttttttcggctctatatcagctttgaggtatatcggcgatgtgtaaaccggctcccgtttgattttttgcgcgaataaatcatcagaaacagttaaaacggcaacgccttttttgctgtaagccgtgcggatcgcctgattcagaagatcgggcagcgcttctgccgtatgtacttgctggttgaataccgccacgtcctcaaacatttgctctaatttgatttcctgaaagctgtcacggccgatttcatcggaagccacctgtcccgcaatcgccagcaccggaacgccgtccgctttggcgtcgtataaaccgttcagcagatgaacggcccccggtcctgcgattgaaaggcagacaccgatctggccggtcagttttgcctcagccgcggctgccagggctgcgacttcttcgtgccgggtttggatgaatgtcaggttattccgttcatgtctcagttcttcgataaattcattaatgctgtctccgggaatgccgtatatatgaccgactccccattgttcaagcagctccgtcattacgtgtcctgctgttttacttggcatactgcatcctccttttacctgtattcatcccctttttcatacaggttgaaacacgagctatactctcagcttttttcttagcagatcaaggatggataacagatttcggtctttaaggactgccttttgatttgccgccccattgagtccgtcttttatttgccgttttctgttcggcaccatgaacagcggcagccggtttggggaaaaccagcgtaaagcggcggtttccggcccgttcatcagcggagttcccccattaatggctccgatgaatacatgttgtgtatcttcaaatgccggcctttcatactcaccggctttttgcaggatggtcacgttataaccggtttcttcgaaggcctctctgacggctgcggcttcagatgtttcaccttcttcaatcctgcccccgggcaaatcccataagggaatgtcttttcgttttacgagcaatatgtcccgcccgtcattttgtatgatgacaaaagcgccttgtgccatgtcgtcctcctttacaaaaaagaccgcggcattttagcctgcggtctttgccgttactttttaaaatgatacggcagggtggcgacgattatgtccttcttccaaaacagccggacgcggagcaagaaggctgattggttgtgaaggatggtctgccagcgttttttcgtgatgaattgcggaaacagcaccatcacggagaactgttcttttttcgctttctgttcgaccgtttctaaaaacttatcaaacgggtgaaccagactgcggtatgaggaatgcagggtgacgaggcggacgccgttatgaagttcttcccagcgcttttctacctttttttcgttttctctgtcaaaggaaacatgaaccgcaatgacctgatctgataatgatttcgcatactgaatcgatttttggacgacggtggtgacaccggcgacaggcacgatgacgacggttccccttatttcctcaggctgctgatcaacgacccgcagctgttcgccgaccgcggtgtagtgatttttaatgacgaaaaacagcatgacgacagcaggcatgaataacagcaccggccagacaagattgaacttcgtcgcgaataaaatgcacagcaccataaatgaaatggcggcgccgcatgagttaatcagcatttttactgcccagcccttcggcttctgcctgatccacttgatgcacattcccgtctgcgacagcgtaaacggaatgaacacgccgacggcataaagcggaattaaatgttccgtgcggccgccgaataaaagaatgagcaggatggacgcgataccgagaaagatgatgccgtttgaaaagcctaaccggtcgccgcggaccgtaaacattctcggcatatactgatcgcgcgctaaattaaacgccagctgcggaaatgcggaaaagcccgtattcgccgcaagcacgagaatcaatgatgtaacgccttgaatgaaataatacaccgtatggcggccgaaggtttccgcggcgatttgtgaaataacggtctcgttaggcttcggacccgtgccgtagccgtacgccagcaccgtaatccccgtaaataagatcgccagcagaatccccatcatggccaaagtgcgggccgcgttttttgccggaggatttttaaaggccgggatcgcgtttgaaatggcttcaacaccggtcagcgccgaacaccctgaagaaaaggccttcagcagcaaaaacagcgtgatgcccgccacgggcgtgccgattggtgtatgctcggccggatgaacctggcccgtcatgagtttaaacagcccgacgacgatcaaaaggacaagcgccgccacaaacagatagacgggatacgccaaaatggacgccgattctgacagccctctcaaatttaaaatcataatcagaatcacaagcaaaacagcaatgagcaaatgatacgggtgcagggccggaaatgccgatgtaatcgcgtcagttccggcagaaatgcttaccgccaccgtcagaatataatcaacaagcaatgagccgcccgcaatcaggccgggcttctcaccaagattctctttagaaaccatataagcgcctccgccttgcggataagcgtaaataatctgtctgtaggacagaatcaaagcaagcagcaaaatgagaacaccggctgcgatcggaatggaataccaaaacgcggccgcgcttaccgcagccaaaatgatcagaatctgttccgttccgtaagcaactgatgacagcgcgtctgaagaaagcatggcgagcgccttgagtttcgtgagtttctgctctccggcagcctgtgatttcagcggtttcccaatcaaaaatcttttgattgaatggtacatttgttgtcttcccctttttttcattttccgtttgatttacaaacccttactgctatgatgtctccgaatgctgattgcatgccatatttcagcacagcaaaaagacacagaggcaaacggatgcccctgcgccataatcgtgcacaggtttcattcatctcctctcatgaacgcttacgaggttagctgtcggattcgggctgatgagagttggccctacctgaaaaaggattcaccccaagcggcatcacgcgccgcaaattggttcccccgctctgattacagattaagcgatatagattataaaagagatcatactcccgtcccgttcagttgtaaaggggcttttatgctgtttcaaaaataaaaaaatcaccgccaaaaatggaaataaaaatacaaaaaaaagaggcctgttaacggcctctttttccatcattactcttcgcttttttcatgatccgcttttctttttttccttcttgccgtcagccagatcagaccggctgcaatgatcataagcgccgcgaaaacagcaatatacgtaacgttcagtgctgcggaccggctcttcgtatcagccgccggactgctgtcatcggacttgatttgctgatgattcgaaaacagctgtcggccggctgtttcgttaatgacagttgcggcatcgcttgtgctgtctaaaaagctgatcagctcttttgtgacagacgcgccgcttcctgataacggagcaaaaacagcgatgcttcggccggagtcccaaggtgattcctgggtaaacgcgacttgtttcgtcgtctcattcagcatctgaaacgaagaaacatcgtacgcgccgctgcggtctgacggcacgagaagcttagaggcgtttgactttaaaagcgggatttgcggcaggcctccgataaacacaacattccggcctttggcatccgcttccttcatgtctgatgccgtctttacggtaaagccgtttccgaatgaatccgccaccagagaaagctctttcagtgtctgcatgtttacgtcatccgggatgacgatcactgttttctctttcccgccgcccgcaaacgggagcggccattgcccgaaatcagctttctgcgccgcatcgcttaccggatacgtcagcgtgctgcttttatcaatatagacccatttgttttcgtcacggtcgacacacggattgttatgtttcaaacctgatgtgacaaattgcagatcaatgtacctgctgcttcgcaaaagcttcggatcaatcgggatggagacgtggtaaaagccgtctttatctttattgccgagatcatcaagacgcaccgcattcggctgtccgttgaccgtgacgttcagctccgctctctcggcgtcatttgctgaatccgccttcgtccggatcgattccgacgtctttaatgtaagtgaaagcttgaccttaccgtctttatcaacagcggccgccgcagggtaaaagaagtgctctgacgccgttttgtttgatccgaccgttacatttcccgcgccgaagtcctctagtgtcagtttattgcctgtcttttccgcagcgggctgaaggcggccgattgtcaaagtatctccgcccagctggcttgaataagcgctgtctgtgatgacgcggattttatccgccagcgttttgtctgattgcgccgtgacaaacaggacgggctgacgtttgttccctgatgtcagaacccgttcagcgagaagaagtttgttgtcttccgctttgatgttcccccgttcgaaaagctcgtttattttcccgttccaatgctgatcagcgccgatgacaattgacggattgctgattttgccggcgtcggattcttttacataggataccttcagcctgctgtctgccgttttcagaaatgcttctgttttgactgcggcttcagcttccgccgaggtcggtttgtcaggaaggataatatcggtttcttcacccgtattgcctgattgggcaaacggatacgggaaatggccgagatccgctccctttgacttgcttgcttctgaaagcacaaggcggctgtccggataaatttttatccagttgcctgacgtatcctgcctgacgcagacgccctcttttaatacgccgtaaaatcgtaatgatacattgtgatagccttgggcggattggcttttgctgagattgagcttcaccgttttccgcttggaactgccgtcaagctttatggatttgacgggttcatcatcaatggcgatggttaaagaagacggggcaattaataagtttgacgcctcgtaatcaatcagaagcgactgatccgcattcgaagctcccgcaggaatctgataggtcagctctgcgctgtctttcgccccgtacagtgtcatcagatcgccagtcagcgcctgctgctcttttgcgccggcgcttgttccgagggcggaaccgtccgttttcagttcccgggccgcggccgcctgcccgttatacatcaatagcaaaaggccagttatcaatatgatcgcttttttcaaaaaggtcacccgcttttattttgattgtatcgctccgttttgtaccacttgacttcctgcttgaacaagcggtgcttgatctctgtgaataatgaccagatgacgagcacgatccaagcctgggagtatgtaaagtacatcagaaatacgataaagaagttttgtttgttcatttctgttttttcaatgcttaaagtaatcatgacctcagtcataaacaggaaaaaggccagtatccacaaaatcatcgccaaaaacccgacagccagatgcaggtcgtaaaaaagattgatgataaaaatcgtgtttgacatgatcacaccgaagaaaaataaaaaatacgtaaaaaagaaataaaacagatcgaagatgatccgcttgcgtttcagcttaaaaaattgggataaaaacttgagaaccacgtattggttgccgcgcgcccatcttgtccgctgacgccaccacaccttccatgtctcaggctcctgctcccatgtcacagccgccgggaaaaagcggatatgatagccgagattatacacgcggatggtcagctcggtatcctccgccagcgccttatcatcccagccgccgagccgttcgataatgctccgcctgatcgcgaagttcgttcccgggatggtggcgattttgaaccatttccatctgccgccctgcgccatccactgaaagcagatggtttcaatattgataaacttcgtcaggatcgttttggccgcgttgatgacacggaatttcccgacaaccgctcccgctttctcatcattcatcagaccgagaaccaggtagtacaccgccattttttccggcgtgttgtccgcatcatacacgcagatcacgtctccgttcgattccgcgaaccctgagttcagcgccgaagattttccttttccggcgttcgggggctttgtaatgaccattttaatgaagtcatactgacgggaaaattcattgacgatgtctcccgtccggtcggaggagttatcattaacgacgatgatctcaagcctgtctttcggataatacagattcaccatcgccttcagcgtctgcctgatgacgacctcttcgttatgcgcgggaatgagcacgctgaccttcgggagctcccccatctttgcgcgccatttcggaatgttccgttcgaaggtcatataatgcctgaatccgccctgcatcagaaacatgtgatagagaagcatcacccatattaaacttaatgagataaaaaacagaatgttactcaaggcttcttctctccttaaaaattcgtttttttaatgtggcgcgcaaataaagaacgtagcaggcgaacatgatgataaacaataacaccacgccggagagaatccaaagcgctttttccagaggcgtctgctgatggtgattgaaaaaggccgttatcggatgaatcttgttttccacatgaatggttccgtctccgtccgttttgatcctgacgctgtccgacgttaccgtttgcttcgttttcttcagatcgagccactcgccgccgggaatccgctccatctgattgacgagctcggggaggtacttcatgccgagatacggatggtagaaaccgcccgccactccgccgccgaaatcaatcatctgcgaaatatgattctccatatctccgagcggattttcctttgagttatcggcataaccgattgtttcagggtacagcgtcatcccgtccagcatagccggctttgagacgaacggaggggcgcccgaggttttccacgtcgtgccgctgagctgcacttgtccgaaaatgctggagaaataagaagatgcgattttgtagccttcttcagacatcgtatagtgcggcgcttcgaatgacagcgggtaaaggccgagctctgtcaaatcgtcaatcgcctgcttcagcttcgttctcgtgtagattttttctttttcacggaaaggcttcacatacgcccggtacgctttttcattcggaaaatcctgttccttttcaagcttgaccggagtatcatccgcattttctgacgtaatcggctgatccgctttggcatcccaaaattcaaagccttctcccgtttcgctgtatcggtatgcgtgcgtgtagccgtgaataatgatgctgccgcccatttgctgaagttttttcaggacgctgaccattttcggtttgtccgccaagtatactttttctccgttttccggattgagatagaccggaatgaccgccagaataaacggaatgtgtcttttatgcaggtaagcgcccgcttcgtaaagcaatgtttcatctgacatcggactgatgtcttcaagccgtaaataaaggagggtgccgcccgctgattctccgaatgcgttgcgcagcgctttcgccgtcagaaacgaatcatttaacaggctcgtcacaccgaaataatagtcagagcgcgccgttttccacataaaagggcgggtgctgccgtcaccggaccggtatgtataaagggactttccttttactcccgatacgccgagcacggacatccctttttcaagcggcatgtctgttttttcttctttgccgtaaatgcggtataccgtttctttctctgtcagggacaaacccgcaaattggcggaactgtccggcgttatagccgatgctgataagctgctgcggcatactgctgatcagagacacaaatgatgtgctgagcttttttttcgtgacgccgtaatagatgacgcgccgattctttttgaggtccgcggctgtgatgtctccgtcgcttttcacggtgacggcggatgagaaatggcccgcggtcagatcaagcattttgacctcagcggtttctttgccgtccgtgcttgtataaataatgagaatgccgtcctttttgtcttttgcttccgccgtaaggggaacataaaccgccgaaatcatgaagagcgccgagagtaagagacgtatccatttagagttcattcatcatcatctcgttttccagttcatttaaaaattgctcagccgtttgtaaatcctttcggtacgccaagtaacatacacggaaggtgatggagacgtatttaccgttttgcagccggtacgtatccaattcctttttcagcttcgccagaacggccggcatgttttcttcaggcgtatgggtcagcacgatgccgaaccgttcggcggacggcctgaattttttgtctgtttcccgaacgcttgaccggatttggcggctgataaatgccagcaggcggtcggtctctttttctccgtagagggatttgaattccttgaaataatgcatgtgcagcagcaaaaagacgaaggaattgccgtagcgttccgcccgcttgatctcctcggaaagctccagcttcatccgcagatggttgtcaaagccggtcaccctgtcgacggcgacaaagctcgtaatctcttcacgcagctgtttcactgagcgctcaagccccttcgccaactcgtgaatccttcccgctatgtaagaaaagagcagcagcgcaatcccccaaatgaccagcacctgcagactttcggcaacggcagacgccataaagctcccggtctgaaaccacaggagcaggctgccgagaacaaataagacgagtaaggtgatgacgagcgcgtagattgccccgaaccatatgccggctcccgtgacaagcaatgtgatgcaggttatcagaagccctgcggattgctgagacgcatagtaaataaaaaaagacagcagcaccagcataactgctgtgtagctgcacagtttttgtgattcattgaatgatattttcattaaacaatttcctttcagccagaagcggcagcaggttatcgaaagaatgtgtatcgcccccgctcatatagccgccgtaatcaggtttcagcgtgtccagtgtttcaaatgaagtcattctttcataaagcggcttgatgacagccggatcagctttttgctctgctaaaaaaagaacggccagggcgtaaacggacggtgattcgtattgaaccgccggctccttcgtgtctgcgctgtatcgtccgtacagctgtccgcgcgtcttaaattcctttatcatccatttcgacagcacagcggctttgccatcgccccgcttcagattcacggcggcgtacagctggtcgatgacattgacttcgctgtcatatttgtattccttagtttcggtattgaacgatttcggcaaaaaaccatttttcaggggcgcaagattgagaacatcgaggttccggttttccgttttctcctcgataatccccttttctctgagcatctgtaaggcgccgggatcgacgtaggacaacgtcacggtctttgacgcggcatttgaagcggcatcataataatccgtaaaatacccgtcattcgtattgtatttttccagcgccttcccgatctgcaccgctgttttcccgtattcactgtttccccatagggttccggcctcattcagacagttcatgattctgaaatcgtcaattaaggcattggcgccgctcgctttattcccgtcaatcttccacgacacgagctcatttttcgtcagaaacgaatcggtgagaagctgatattgcgcttgaaactgccgttcatctttcctgttcagcaaaaatgccatccatagtccgagagactctgataaatattccggctcaccggttatgttcgtccggatcatcccccgcccgttcatcaatttatgataaataaaatgctctgcgggctgaagcggtccggacggttcggccgccgcctgtttttcagtgccggcctccgcgcaccccgccgtcagaacgatcgaaatcaaaaggatcatcagacgaaaaacgaattgcttcacagtctatcctcctattttataaacccttttttagacccatatcttattttttcacaaagtatttttactatataggaaacgataaaagaatactagcattttttcacattgggaaattttaaatgggagcgccgtctgctcaccttttccctcttcgtctggatcgtattcccattacagttaaaaacacaacaaaaggcagcatttctttacaaatgctgcctttctctgatctatttatccaggccgagttttttcagctgttctgccagcgcgttgttcatcggctcctctttgttttggcttttcatataagagttgatgtcccgcttggatgcgcgtccggatttatctttcgccttgcgcttttcaaagacggacagtttctcccggtggccgcatacacatgcgaaggtttggccttcgccctggccgcgaagctccattttcttatgacagttcggacagcgggcgtttgtttttcttgccagcgttttccggctgccgcactcacgatcctgacatacgagcatcgtgccgcgtttgccgttgactttaagcatcattttgccgcaatcagggcaggcggtgcctgaaatgttgtcatgtctgaaagtctggctgctgtttttgatttccttcaccgttttgcccgcatatgttttcatgtctttaatgaacacggcggatttcagtttgcccgctgcgatggcggagagcttttgctcccactcagcggttaaggccggtgattttaaatcttccgggacgagctgtaagagctgcttcccttttgacgtgatgaaaatatctttttcttttttctcgatcaagaaactgttgaacagtttttcaatgatatcagcgcgggtggccactgttccgagtccgccggtttcacccaatgttttcacaaggttcttctcttctccctgcataaaggcgcttgggttctccatcgcggataacagcgtgccttcattaaagcgcgccggcggtttcgtctgtccgctcgtttctttcaatgatgagacagtgaggcgctgaccctgctgaagatccgggagcgtctggtctttgtcttcctcatgatcgtcgtcatcctcgtacatatcatacacggctttccagccaggcgattgaaccgttttcccttttgcggtaaatgtttcgccgccgatattggctgtgacctttgtttcctcgtattcgaacgccggcattaacacggcgagaaaacgtttggcaatcaggtcgtaaagctttcgttctttgtcgctgaggcttgaaaggatcagcggctcctctgtcggaataatggcatggtgatccgatactttcgcatcattgacgaatcctttatgcgctttgacgccccgcttcagtatttgattgacgtactgcgcgtacggcttaacttccatgccgtttaaacggtcttttaaagtcggcacgatgtctgcggaaaggaatctggaatccgtccgcgggtaagtgacaagcttatgctgttcatacagcttttgaagcacggacagcgtctcttttgcggagaaaccgaagcgcttatgagcgtcccgctgcaattccgtcaagtcgtaaagaccgggagcgaagcttttcttcgccgtttttttcaattctgaaatgactgccggctttccttgcaggtcttttgccaaacggccggtcaccgtctgatcgaatgttcttgtctgctttgtttttttatcctgccatgtcagcgtcatctgatcagccgccgcgcggagaccgtaataaggaacgggtttgaacgcctgaatatccgcttcacgcttggcgatcatcgccaatgtcggagtctggacgcgtccgcatgacagctgcgcgttaaattttgtggtcagcgcgcgggtcgcgttgatgccgacgatccaatccgcttccgctctggcaacggcggaatgatacaggttttcgtactctttgccgctgcggagcttttgaaatccttctttaatcgccttatccgtcacagaggaaatccacagccgcttaatcggtttgcggacgtttgccttttcgataatccagcgggccacaagctccccttcccgtcctgcgtctgtagcgattacgatctgggtgacgtctttccggacaagctgagctttgaccgcattgaactgttttcctgtttttttaatgacgacgagcttcaaaggctccggaataatcggcagatcctcaagccgccatgattgaaattctttgccgtatccttcagggtcagcgagcgttaccagatgtccgagcgcccatgtgacgatgtagcggtcgccttcaagatatccgtttccttttttatgacacttcagaacgcgggccaagtcccggccgactgaaggtttttcagctaatacaactgtttttgacatgcttttcacttctctttctttcacaatcatcctgttattataacagacttcctcacgctctctctaatcgaggacgttttttgtgtcaatttctgagaaaatgacgtgggtcacggtttgggcatacggagaggtgcggttaatgaagtgttcgatcgtttccaggctgtccgcgttcatcttcagcatataacacgccgccccggcgacccgaaaacaaaattcaatgttgggaatggattgaatgtaggttttaaattgatcgtattttccgtttttcactgtcgcttcgacaatgcaggaaacaggaagcccgatctttttttgatcaatgtccaatgtatagcgcttaatgacgccgaaggattcaagctgtctgacacgctctgtgacggacggagctgacaatttgatttttctgcccagttcccgcatggacaggcggctgtcccgctgcagctctttgatgatgctcagatccacattatctagtttcatgactgtagtccttccttacccttttggctatattatcaagagaaatccgaaaaatgacaagaacaacaggctgaaatcatgaaggttttttcaggaacagacgcgaaatggtcatattaggactgccctttgcttatagtatagaggaaaaaagatgtccgacaggagggagctgtatgttacacacgccgatcggcagacttcgcacgatggggtttattgaaggaatgtcgcttttggtgctgctgtttatcgcgatgccgctgaagtattgggctcatcatccgctcgccgtcaccattgccggttccattcacggcggtttgtttatcatttatctggcggtgctggcgtatgcggcgtttactgtcaaatggcatgtgaaatggtcagccgccggttttatcgcggcctttattccgttcggtaattttatttatgatcgcggcctgagaaattatcaataaaaaagctcctcttctgcagaggagcttttttcatgcgttagttacatccatttcgtcacccaggcgatataataagcgccggggatgaatacgagctgggcgagaagcgtgcccgccacccttgatgtcaccatcgtcaatgatgtccattttaaggagacgtagctgcgcttgcccttcgccacatcgtctgccagtacggatactttcgggtcaacaaacacagccaacagcatagtcgcaactccgttgattaagcctgatgccatcacggcggtcgtgctgtgctcaggcgccagaaggccggcgtacagagcggacagaacaccgatcgtgtaaatagacgtaatgaccatattaatgacaaacaagcgtttcggaatcattcggaattgaagcccttttaaataggagactgacggcagtctgatataagaacgcgcatgcttcagcccgttcagtgaaaatccttttttaaatacctgcatgacggagcctcctccgtccgccaagtgtataatcgccctggagaataacgcgacgaatgtcggcaaaagacagatgccgagcatcgttccgaccgtggagccgaatattaaaaatcgaaactgggcgcccacaagagacagggcgtttgatccggcggcatcaatcagatgtccggtaaacggctgctgaaccatgtttgacatgcgcgacacgatgaccatgacattaaataatgacagcgcggacgcgataaaaccgactctcgcgccggaaagccgtgttgcataggcaagcgtttcaatcgaatgtatcagcaacagaaaacagaagataaacagtacttgtgaagtaataacgtgcaatgtatgattcctccaaatcttttctactgattagactctgcagactgcggcgaggtttcggccgtttacataaaaaaaccgcccggatgtccggcgcggttttgtcttattcttttcttacgcaaataaataatatatggttgcccgccttagcccgcgggtgattcgtattaacagttccgacagaatcattcttcgaaagtaaacaccatggaagttcttgaacacaagacaacgaaagccctacctctcaatcgtcactgcggctccgaagccgcgccggtgtgaattgtaaaacaaaaagtcttttttccatctcttcgttaggggcgaatgtcagaaggaaaagaataagctcagctttttttcaagctgtccgttgaagcctgaagcttctatatcaaaacagaaaaaagaagtttactttcttttttatttgcatgttgtcacttagcaattaagtataacagattgcccctgaataatcaaatgatttattaaagttccagctcggccggcgttttttcacccgcgttcatgagcttgatctgcttcggttcaatttcaagaatcaccaggttcggatcgtcttttccgtcaaaccagcgttccagtttcggatcccacagcttttcttttaaatcggctgagttgttcagtttggcggttccggccacttccacataagcgtctccgaatccttcacagtcataccctaacagaatatgaacattcggattgttttcaatttcttccgctttatgagtgtctttgctcgtcggcgtgtaaatcgttaagccgtcatggaaaaatgtcatgtagcgtgaatgcggtttgccttgctctaccgtcgcaagcgaaccgactttatgatgatccagtacttcaagcactttttctttgatttcattttgattcatgaagaatcactcctttttaacgtctccgcttttacttttccacattggggagacatttaaaccaagaaatgtgctcttctgccgatcttcgctccattcccgcttcagcatgctgtagttcaccgtgtcatgataggcgccctgtacgaaaatgccttctctcgtcagtccttctttctgaaacccgagccgctccgccaccgccctgcttttcgtgtttttttcagccgcgctgatcataatgcggttcagcccgagatcctgaaatgcatgggtgatgaccgcccggcagcttgcggtgataatgccgaatccttcatgctctcgatccagccagtagccgatctctgctttttgattgactggatcgacattatggatgctgatcatgccgcaaaaccggcccttcacaaaaattccggcgtcaaacccattctcttccgcgtatttatagcgccattcggggatgatcacatcgcggtacgtatcgatatcagccagttcttccgcccagctgagccattcgctgagatggttttgatttcgcttcataacagaatacaattcgtccgtatcttctttggcaagcaatctgatcgtcagatgttcccggatttgacaggaaaacacgatcacaccttctttcctttattagccattatacaggtaaattcatttttttccatacaaaaaaagatgaggcgtgcagcctcatccttaaatgcgcgggtcggtgaaaacatcgtgatcatccgtgcttgtcgatgacatttccgtgacgaccgccccttcttctcccgcttgaaaccaatgcttcgtatccggcggaatggtgtattgtccgcccggctcaagcacaatctcatgccagacggtgtagtattccttgtcttcttccggcgggaggacgcttgggttctctgtcttttcgccttccacgtagagatacaccttcccccagcggcagcggaatgtctcttgttttcccttctcgccgccgaccggcggatggcggtgttccggacacgtctgccgcgggaagagcaccaattctttcgaacagtagcggtcggtattcacgtaaataaacagctgaagcccggtttcctcaagcttgcctaagccgtaatccatgatttgaatgtcttcgacttcattatcagtcagaacgattcccgctttttgatagtatgcattcacatcatgtttcgatatcgtcatgcttcagcccccttatgtggttacaaatttgccgccgttgacatgcagcgtctgtccagtcatataagatgattcgtctgaggccaagagaacatagcagccgacatgttcaacaggctggcctgcccggcccatcggcgtagtctgaccgaaggaagcgactgtttcttctgagaatgtcgccggaataagcggtgtccagatcggccccggcgccacggcgttgacacggataccgtcgttgacgagcgcttgcgccatggatctcgtaaaaccgttaatcgcgcctttcgtagccgtgtagtcaatcagctgcggattgcctgtgtaaggattaatggatgtcgtattgatgatcgcgctgcccggcttcatgtaatcaatcgcttttttagtcaaataaaattgtgagtaaaagtttgttttaaaagttctgtgaagctgctcgcttgtgatgtctttaatgctttctttcggatgctgttccgcggcgttattcacgagaatatcaagacgcccgaattcttcaaccgttttttcaaccgcttcattgcaaaagtcttcctcaccgacatcgccggggattaacagacattttacgccttcttcttccactcgtttttttgtatcttccgcatcaccgtgttcatcaaaatagacgatcgcgacatttgcgccttccttcgcgtaagcaaccgctacggcgcgtccgataccgctgtcgccccctgtgataagtgcggttttcccttttaatttatcagcgcctttatattctttgtattcataaacaggcgtcggattcatttcgttctcaatgcccggctggcggttttgtgattccgctgggaattccttcggatagttttccatgtcaagttcctccttcttgttcgatctcatatttcttgtctacctcggcagttctccggataaacatgattgagacagttcaaaacgttttcggagaaaaatgtttcacatggaacgcaagaaaaaaacccggctggcagccgggtttttgttttcaattatgaacgtaccgcttgtttgcggagcacgtcttttctcacttttccaaggttgtttttcggaagttcgctgacgaactcaatttccggaattttaaaggcggcaagacgttcttgaaggaatcgggtcacttcttcttctgtcaggtcttctctgccgtttgtcacgatgaacgctttcggcttttcaccgtaaagcggatcagggataccgacaaccgccgtttcgagaatgcccggcacttgctgaatgacctcttcaatctggtcgggataaatattgtcgccgccgtagatgatgacatctttataacgtccggtgataaagataaatccgtcttcatccacatatccggaatcgccggtatggaaccagccgtctttcagcacttttcgtgtcgcttcttcgttaccttcgtagcctttgaataaaaacggacttgtcacaacgacttctccgattgagccttgcggaaggacttcacctgtttccggatctacaacgcggacatccacttcttccatcggtttacccgcggaagcggctttatccattcccatttgcggattccaagagctgatgccccacgcttccgtgcttccgtatccgtgcatgagcggaataccgatgtcgagatactgctggatcaggctgcttggcacctttgtgcctcccgtcatcatataaacgatagaagacatgtcagtctggtgcgtttcccatgctttcagcaggtatgtgaaatagactggcagcgccatgatggtttgaattttttctttttcgatgagcttcaggttttccacagggtcctgattgtctgtcataatgaatgtcgttccgctcatcgtgccgaccatctggcagataatcgcgctcgtatggtaattcggatggcatgctaagaagcggacatgctgcattctccccgtgtatgccaatgtcgcgttgacgtagttgtatatgccgccgtgagtgatcatgcagcgtttcggattgccggttgtacctgaggtaaacatcagcaatgccgtatcgttttcagacaccgtttcgacatccggtgtctcaccggagcctgtcaataaagcgtcaaactgaggcgttgtctccgcagctgttccggtctcgaccttcagtttaagagaagataccagcgcaggaagcacttcttccataatctctttaaattcagtgctgtaaaaaacagctttcggttcacaggctgctaaaatgcctttcatttcgtaaggtgttaattgccagctgaccggcacaactaccgcgccgatttcgagtgccgcaaacatgacaatggatgccgcgtggccgtttttgcaaagcatcgccactctgtcgcctttttttattcctttatcaagaagcgcttgtgcaagctggttgattcgttttcgatattcagcgtaggtcagggtatgcgcaccgctttttacagcttcaatctcttcgctatttgaaatgtcatgcagaatcagatgctgtaatgtctccatattttcatctcccataatgataaatcacaaaaaaactctgtcagattttctttctcacgcaacccattttaaaccaaaaaatataacttgtaaaactattttgttttagaactattccatcagtgaatgatacaatagtcccgtgtttttagtttcttcccttccccttaccctcatacatgcacaaaaaaacacaccccacatgaggtgtgcgcttcctgtttaccgctgtcctttctcctgaatgaaatgataaaacagcttgtttaaacgtttgtataaatcggcctcatcctcagtctggaaggcttttatactgtcttcggactcgatgatggccgagctgaccgcacttagtatttccgacccttcagcgggcatatcagccggcgccatcatcaccaaagcgcggtcgacggtcagggaatttccgtccatgcctttgacactgcatggagctgtcaaatcataaattttgaaaaaaggcgtgacaatttcttcatttttgagatggtacagggccatcgccgttcccggaatgccgagtccgccctgtcgttcacgctcagcaaggcgctgtgcggttttttgggcattatgaaccaatccttcttgctccagcatgtcaaacatacggttcaaaaacagttcatacgccgtgtttgaatcaatggatttgaccgaaaagttccgcagcacgctttggataaccgccgcgtaatgcgccatacggccggccgcttccagcatatcaggcgtctccggctgcttctcttctcttttaccgtttctttttttgtcaagaatcagcggaatttttcttttgatgtactgcttgacctgatcagcgtcttcttcgtttaaaagcggactgaccatgacgtaatcaatgttttcatacgggatcggaacggtggatacgatcatgtcatacgcggtgatgtctcgatccttcagttcgatgagggaagacatatcaaaggaacggatttccggaagctcttttttcagcctggatgcgagcattttggacgacccgatgccgcttgaacagacgatcagcgctttgatcttcgcttcttcccgtttgatttccaaagcggagccgaagtgaagaacgatgaaagcgatctcattatcagagaaaagaagccccggaaagaatttttccattccttcttctacggccatgtacagcagaaagtagtcgcgtttaatttgctcggtcatcgggttgtacatgtcgatattttcttttacccggttgatcgcaggctctagatgggcgattaaaccgtcgtataaagaaccgttttccgtcagatcaattttaattttttcagaaatgaagccgatcagctgcttcgtttgcaaggccgtttcaacctctatgtcttccggtttgaattccgttttgtatttgcggttggcgctccgcaaatgaatggtgatatatccgatctcagcttccggaattgaaacgccgaacgctttttcaagctcttttgccatttccagcgcagagccgtactccttcgtctgctgcagcgcttttagttccgaagcctccatcgtgatggtttctccgagcctgatccggtccatcgcaaaggttaaatgaaccgcaagcgccatgtatgagctgtcagataaggcgatcgcgattttttccttgagctgaattaagagccggtccattttcaaaagttccgctttatttacgacgccgaacattttttcagcatcgttcggttttcctttaatattcaattcaaccgcttccaaaaagctttgaatatcaaggcggttgacgatgagattgccgacgattttccgtttcgcattttccggccccgtcagctgaatgccgaagcccctttttcggatcagcgtcaagccgaagggcgcaatccaagtctccagctcatccaggtcatagctgatcgtcgcgtttgttacttgcagttcgttcgccagactgtagagcttgatcggctcttgagactctaatagtgaacatagaattaaaagtttccgctcctcagcgctgtattcatgctgttcataggacaggtctgacaggagtttttgtttgtcctccgggtttcctaccgctttcagtcctttgccaggctgtttatcaagtgccagaccgaatgattccatcatcggtttgattgttttcaactcgcggtgaacggttcttgtgctgacttgtaaagcttccgccagttcatgcactgtctcgtaccggttctgcagtaatagatgtttcattaatttttgttctctcgctgtcatatacatgaaacgcgcctccagattttctagttgtgagaagtatggcatatggggagtgctgccggggaaagtggtgtaagctataatataaaacgctttcaatgattattcaaccattttcaaatggcaatttggcactgggccgtgtgacagtattgaaaaagaaaaatgtgtcagataatatgccatgacgcttgttactcttgatccgcacggctatacttcaaagtgaccttacttgtttttagacattgcacaccacataaacaaacgcccggaagatagcttccgggcgtttgttctgtttatggaatatcgcagccttggacaccggtataaatccggaaccactgatcatggctgagtttgtacgcggatgcacgcaccgcggcggaaatgcggttctcttttccgctgccgacaatcggcatgatgtctgccgggtgggtgaacagccatgcgtacatgacttcgtcaatggaagcggcgccgatttcttcctgtacggaacgaagcgcggcacggatacggacgtccttatctgattgtccggtaaagacgctcccgcccgcaagcggtgaccacgccatcggcggaatgcgtttttcctgacagaaatccagcgtgccgtcatgaatattttccagctcgtacgccgagatttcaatttggtttgtgatgagcggatcatccaaataggattcgagcattctgtactggtgcgctttaaagttcgacaccccgaaatatctgacctttcccgagcttttcagcgcatgaaacgcttcagccaccgcctccgggtccataagcgggtccggtctgtgaatgagcagcacatccagataatccgtattcagattcaagagcgactcctccgccgacgctaaaatgtgagacttcgacgtattataatgatgcgacttgtttccgggccgttccggtgattcaatgacaatcccgcattttgtgacgatttcgattcgctcccttattgaaggcgaaagggacaaagcgccgccgaagagcttttcacacgtataaccgccgtatatatcggcatggtcgaaggtggtgatgccttggctgatacaccattcaatcaaattcagcagctctccgtctgaaacattccattcgttcagacgccaaagcccgtgtatcactcttgaaaattccaggtcttcagccaattgaatgcgctgcatgtgagatccccctttttcttagagcctcttgtatctctgttttcaggaattgcccatgctgtttcattctgcttcggcggccgattttcctttcagcccgcaaaaatcgtcatttaatgattctgaaactgctttttcgctttttcaacgacgtaatggcttccgccgcgttttttgacgtcttgaatcatcatcgcgatcaagaggtctttctttttataatcgtaaccgacaaaccagccgttttctttgccgtctttatcttctttagacgttttcagctcggctgtaccggttttcccggctacggtaatgccgcttacggccggctgatatgcagagccgcgcggatcttcaacgacgcctctcagcccttttgtgatttcttcggcattggctttcgataccacttgcttatgccagatttgcggtgttttttctccgtctttgatcaatgtcggtttgacgagatttccgtctgttacaaatgcggtatagtcagccgctaagtgcagcggagacatcagcatctgcccctggccgtagcccgtatctccgagaaggatctcggaatcaagcttgccgttagcgattgaagacttttcaatcggaaattggtacggaatctcttcatcaaagccaaatgtttttaatccttttgtaaacgcgtccgctccggcatctatggcattttgcgcaaagtagatgttgtctgatgtgatcagcgcgttttcgagatccacttcattcaggcgctctgatacgcgtgtgacatggtaaccgccccagctcgaatctttctgccactcttttccggtgatttttttcttttctgacgctttcaatgtgccgtttgtcaggccgactgccgcggcaatcggtttaatcgttgatcccggcgcataaagtttgttgaatttcgctgaaaacggattgtttttatcttcattcagctttttccactcttttccgctccagccgaaaagaaagccattcgggtcataagacggtgcgctgacgagcgcgagtgtctctcccgtttgcggttcgagggcgactgccgctccgctgtcatctttcatagaatcatacagcttcgtctgcgttttcatgtcaatcgttacatgaatatcctgcccgctttcggctttcttttcagcaatgacctcacctgtttgcgggacgtaaattttccagccggtcgtgccgcgcagcttgtcttcatatacattctcaaggccggcgatgccgattttggaagtatcgctgtattggccgtctttcgcttttttcagctgctccgctgtgatggttttaatataaccggtcagatgggccgctttttcgccgtacggatagtagcgggagctgactttcgttttcgtcacgccgtctaatgcgagcaggcttttgaccttgctttcatcatccggtctgattttttgaagcgggacataggagtcgtcttttacccagccctggttcagtttgcttttgatatcgtcttcagaaaggtccagtttttcagacagttttttgatcacgctgtctttatccttgccgagttttccagggataatgccgatttccggcacctcggtattcacggcgagaccttttccgtctttgtcgtaaatttgtccgcgcttcggttcttcatttgcgatctgcacggttttgtcatcggaaagctgtttgaaaataaaagaaggattccagtcgatgttccatgattctccatcgtctgttttttcttttttcaggacggccgtgttttcaaaagcgaccttccctgcttttgtatccatgctgactttataatcgatgtgctggaggtcatcttttttcttgtcgtcttcgtcctgtttttcggcagtgactttcagatttttgacccctgcttgttcataaacggtttcatatcgctttacaaaatcctttttggatcgttttttcttttcatcctgggtgaggctttggtacatcttatcgtaatgaccgccgttccagtcttttacgaaatctttcattctgtcttcggccgattccgttttcgagcagccgatcaaacctatgattcctgcgagtaaaagtaataggtataacccttttttcactgtctattcccctgccttccaactgttattttctcctaaaccaaatcaggctggcaaggatttttttctcatattgtttaaaatttttttgtttttcctgccgtcacgggccatattcttatacaatgtatctattaaaaaaagggggaatttcagatgatcagagaagcagccatgctgtatgtaaaagaaggtcttgagggggaattcgaagaggcattccgccgggcggagccgattatcgcgggcatgaaaggttatctgtcccattccttgtccaaatgtatggaaaagacgcataaatatttgctgcttgtggaatgggagacattggaagatcatacaaaaggctttcgcggatcgccggaatatcaggaatggaaagccttactgcaccgtttttattcaccatttcccgttgtggagcattttcaggatctatcagcctcagatcgcgtgaagcgtaaaaccgattaaggagatcgaccatacaaaaacggcggtatagatattgaatttcccggagccgtcgttttctttccgtttttcctccagcccctgaatgaacatgaccgcaccgagaaacacgagcataaccggctgtatgacagaggtatgttccgcatacgtaaatgcggcggccgcaagtataataatcagcatcgcgagtgacagttttaaggcgcgcagcaaagcaatccatcctttctgttatcattttttgaacacaattctatttctgtctttatcccccattattctagcgtattttttgcgcggatagaacgaaagtcggacaattttaagtttgttttaaggagcacgaaaagcgcgctcccgataaaaaggagcgcgcggttatgagcgggcgagggttccgtatccgagcccccgcaggacgcatgccatgacttcataccccttgctgttggggtgtacgcggtcatgagagagatattcattcatttttcctttgaaagcgctgtggacgtccgcaattttgacgtgcggcgccgatgcgagtgtgctgaggtgcgcattataagaggatatccatttttctgcaatggagatgcccgggaaaggattgtataaattgaagacgcggatctcataaggagacgggtgcggcccttttaaggcagcgatcttggcaatcatcttttcaaagttctcatggcagtgactggacacgctggtgaacaccgaagcgtccgatgtttgctgatatgcctgaaccgaatcgatcaaatcgttgccgcagcctgtaatcgtaatcatatcagcagcctgaatccgcctctgaatgtacggcaaggacataagcccgagaatttctcccgtctcaaggcctgatttggcaaagatggatacgtcagttcttgtctgtaaatcttctgccatcatacgcccaaaccgctggacaaaaccggcggaaaacggcccggatcccctccccgtcgtcaaagaatcccccagcgccgtataaacaagtcccatttactttcctccactcgttactatcgatattgtaatgtacgcgagtgaagaaaaattggctcggtcaataacccaatttctcagaaatatgctgtgcggcggttttgaccttttcggttaaatacggcagcctatcctctgaaaaccgggcttcgaagccggcgatgctgattccggcagccaccttaccttcgtgattgaaaatcggcgccccgatcgccgccgtgtaatcttctaattccgaatagctgatcgtataacctgattgtaaggacctttcaatggattgaagcagttcagcccgatccgtcatcgtgcctgaggcgattgcggcaagctttgtcttctgaatgtatgtgtcaatctcctcttttggcagaaacgatagaatgcttctggcgcacgctcccgcgtacagcggcgaccggcggccgattgccgtatacaggcggacggtttgagtgccttcaattttttcgacgtaaatggcttcatctccgtccctcatgatcagctgaacggcctcatccacttcgccgcacagctcttccataatcggtttggctattttcctgatgtccagacgttcagagacgagctggccgaattgtaaaaagatcagaccaagctgataacggccgtccgctgcccgggtgagaaatcccgtttcctccagcgagcttgccatccggtgaaccgaggtcttcggcatttccgatagagaaaccagctcatttaagctcaggctcggttcagtcagaaataaatgaagcagttccattgatttgatgacggttttgtttttgttttccatggtctttagcccctttgtcagatcagccattccattttgagccttgctttcagctccttcagctgctgttccttctctaaaagcagcatttccgcttcctccagcgaaacggcccggaacgtgatatgttcccccggcatcgtttgggcgacgagaggaagatcagcggatatgatatgcgccatccgcggatagccccccgtcgtctgtctgtcagccagcagaataatcggattgccgtccggcggcacctgcaccgttccgaacgtcacggcctcagataccatctccagcggctcccgcaattcaagcggagcgcccttcagccggtagcccattcggtcggattgaggcgtgaccgtatatgactcttgataaaaacgcaattttgcttcttctgtaaaagcgtgaaattgagcgccttcaagcactcgtatgaccggattttttttcagcggcagaaatcctctgctgctgacagaccaatcaggcgctgagaaaccatgctgtccgaaagaatcgctcagacggtacgcgattgattccgaacatggcgtcatacggccgagcggcagctcatcatctttttgcagcgctcttccgcaaaaaccgccgatccccgctctgacatatgtgcttttgctttccatgacggcgggcacgtcaaatccccccgcgacggcgagataagcgcggctccccatcttgcacggcccgaatgagacgacgctgttttcctttatcaaaaccggtttccacagaggggcgggctccccattaatatgaagggcgaaatcagctcccgtgacggcaataaccgcaggttctgaaaattcaaaggaaggcccgggccccatgagcgtaatttccagtcccgcctctttttcttgatttccggcaagaagattggcgatgcgcagtgagatcgtatccattgcgccgcttcccagcacaccgtatttctgatatcccgtccgccccttgtcctgaaccgtcgtcaagagaccgggctttaccactttcatactcattcggctccctccttgatgcggctgtactcctctgccgtgatccggacgaatttcaccgtatcgcccgctctcaaaagactcggcggatgttcttccggcctgaaaagacggagcggggtgctgccgatcagctgccagccgccgggagtggatatcggatacacaccggtctgcattcccgcgattcctactgaaccggccgggatggacggccttggcgacgcctttctcggcgctctgatccgctcagacattcctcctaaaaacggaaatcccggcgcaaatccgagcatataaacgagatattcgccttcagtatgaatgcggatgacgtcttccagggtcagatcgttcatctcagcgacctcttctaaatcgggaccgaaatcaccgccgtagcaaacggggatttccatcacccggcgctcttctttgcggccggtcattatatggctgagacgttctgtcacttctttcttgaccagggcaaaaggagagacgcctttttttatgtttgagacggcatacacatcataaaagatcgttaagcttgtgaatgccggaatacattcaacgaagcccggaaacggccgttcttccatacaggctgccgccgcatgcacccggctgttgacctcttcgctgatgtgcccgccaaagcggatgataacggcggaatcaccgtacggctgtatatcaagcgctgtatttccgctatactgcatcattgtcatcacctcgttgtattctttctcacttacaggacagcaagcgattcatttcgtatatcggtgatcagcatgtgccccggtgaatgtgttattacgatgtcaggctttgcttccatgatcaccgcctggggcgtaacgccgcaagcccagaatacgggaacttcaccttcccgcaccgttacggcatctccgaaatccggctgatgcaaatcgctgataccgatgctttgcggatttccgatgcggacgggggcgccgtgcacggcgggaaaacgtgacgtgacctgcgccgcgcggactgcaagcctttccggaatcggtctcatgctgacgaccatctttccagaaaacgggccggcgggaacacagtcaatgtctgttttatacatggggacattcacaccctcatcgatgtgcctgattggaatgtgctgattaataagggcttgctcgaatgaaaaactgcagccgattaaaaacccgacataatcatccttccaatacggcgtaatatccgttacctcttcagtaagcacgccatgccgataaatcctgtatttcggaaagtccgtccggatatcagctcccggcgcagctattgccggaacgggtgaacccgcatccgtcacatcaagcaccggacaaggcttttgattgcgctggcagaataagagaaaatcaaaggcaagatccttttgcaaaacgacgagattggcttgagcgtaagaagcggccatccccgccgtcggcccggtcatctgccccttcctgatcagctgtctgacttcttcggggctcatgtcactcatatggtttttcatatcatcagctccatagctgcggcatctgcgtgaataatgtatagatgcccataaccgccatgacaaccactacgatcgcccctgcaatcgtgagccagatcggatgcttgtaatcgccgacgatttttttcttataagcgcccaacagtatcatcgctaatgcaagcggcagaattaagccgttaagcgaaccgaccgcgaccagaattttggcaggctggccgatcgtaacaaaaataagagtggatacgatgataaaaccgataatgacgccatgtgagtgcttttcgatttttgttgaaaatgatttgaaaaatgataccgatgtataggcggcgccgatgacagacgtgatagcggcagaccacatgatgacgccgaaaattttatagcctacatttcccgccgcaagccggaatacagaagccgccggattatcaggatcaatgctcaggccctttgagacgacgccgagcacggcgagaaacagggcaatccgcataatcgatgtaatcagaacgcctgtgatggagcttttcgtaacctgagggaggacttccttcccttggatgcctgaatcaagcaaacggtggccgccggcaaatgtaatgtatccgccgaccgtgccgccgacaagcgtcacgatcgccagcacactgatatgatcaggcataaaagttttcacaacggcgtgtccgaccggcggagccgtcgttacggcaacatacacagtcaatacgatcatgacgatgccggcgatctgcataaaacggtccatgacttttccggcttcctttatgacaaaaatcagcaccgcgaccgctgcgctgattaaagcgccgatctccggtttgatcccgaataatacttgaagaccgagacccgcgccgccgatgtttccgatattaaacgcaagtccgccgagcacgaccagaaaagcaatggcataaccggcgcccggaagcaccatattggcaatctcttggccgcgctttccggaaaccgcgataatccgccatacattggtttgcgcgaaaatgtccaaaataatagaaattaaaatgataaagccgaagcttgccgccaatgtattggtaaacgtggccgtttgcgtcagaaagccgggcccgattgatgatgtcgccatcaaaaatgtcgcgcctaaaagaagcgaccatttgccggaagcctttccggctgtttttttcttttgctccatgctgtcttcctccctctgctgctcagtcttttgaaagtgcgctgatttgaatgtttgccgcttttaattcttttttgattgtttttgcgaatgtgagggcgtgggctccgtctccgtgaatgcagaccgtgtccgctttcaggcttacagcttgtcccttacgtgatgtcaccgtgctgtctttcaccatttgaatcacttgaccgaccgcttttttgtcatcctgaatcagcgcatccggctctgaacgcggcgtcagcgtgccgtcttcctgataggtgcggtccgcaaacacttcgcttgccgtcctcagtccgattcgatctcccgctttaatcagctcgcttccggaaagcccgaaaagaataagcccgggatcaaaatgacagaccgcctgagcgatggcttctgacaggccgggattgacggcggccatattatataaagcgccgtgcggcttcacatgctgcatctcgacaccttctgcttttaaaaaccctgacagcgcgccgatttggtacagcgtcagatcatacgcttcctcgggtgtaatcgcgatctgccgccgcccgaatccctgcagatcgaacagcccgggatgagcgccgattttcacgcctttttccgccgcaagcgcaaccgttttgcgcatcacgctgggatcacccgcatgaaagccgcaggcgatgtttgcagatgtcacataatccaaaatctcttcatccagcccgattttataagcaccgaaactctctcctaaatcacaattgatgtcaatctgaaacataagatccctcctgtattgtaaacgttttatatgattatcattccgctattcggaatgactattccgaattgttggatttctcttcattatatttatttctgacaggtttgaacatccttttgtcagaaaacctaccatggacctagtcacaaatctgacaaaacaaaaaaagagagcctcatactgagactctctcttttttctattataacacccagtggcggatcgctttggcgaccccgttttccgtgttgacatcagtcacccagtcagctgtttctttcacaatgtcctgcgcattccccatggcgacgccgacacccgctttttcaatcatggcaatgtcattcagactgtcacccatggccatcacattttccatcgtgaagccgagtttttccgataccttcgccagcgcagccgctttgttgataccgagggcattgacttcgatgttgatcggactggagtttgtgatctcgagctccttgtattccttgagctctttcagcacctcattccgcacttcgtcatcctcgatttcgaatccgaacttgagccactgatgatccgtaatcgtttccgggaattcccctctccacactctatcgacggtagaggcccagaaattcgtgttgtgcttattcctcagatcccataatttttgaatatgatcggtatgaagaagcttgcgctcaaccagctcaaagtcggaatcccagatttcgctgccgtttgccgtgattaaaaaggatgacagctcgagagactcagccagttcgcggcaggtcatcagcgtgcgtcctgtgctgatgacgacgtgaattcctttcgcctccgcctccttgatcgcccgccggttttcttccgggatgagctgctcgtcattgagcagggttccgtccatatcaatcgcgatcagtttaatatctgcgtcttctctttgtatcggcatatatgtacctcactttttataatgtagtcgtctctattttaatacatatgacccacaggaacaaaaaaccgctttctgcgtttggcggggggaacgttgaggaaaagaaatattgaggtgatggaggatgaaagaaagaaaacaaaagaacaaaccgaatgaaaatcctgaacatcatgatttaaccgatccgattccgctggaagagctgaaggaaaacgccaatgacgaaaaacacaaacatgaccaaagggacaattcacaaagtgaaagagattatgatacaaaataacagacttgtacgaaagccgccgctggaggcggctttttttacgatggctggataaatatgctgagctcagcttccgccacaggcttcccggcaacggacgctttcgcccggccgaacacaaaaccgcgtctgattcgcgtgacctcaaaaaaaagatccagacggtctcccggcaaagcggcacctaacctttccgctttcttcaccgcggataagagaccgaggccgtcaccgccggtaattcccgcgcaagccgccgtttgggccattgcttcaacgacgagcgaaaatggcatctctctttgggattcagttataaaccagtcattttcactgatgtttttgtaagcagccgcccattttccggcttcactgttcgtcgtgccgtccatcaaaagaaacggaaaacgatggggcaatagcttctgattcatcacgcagcctcccttctctctcattataacgcaagaaaaaacccgcgtcccccgacgcgggttcatttttattgattgagctttttgagcacgatgccgtgcagcggttcatgcggctgaataccgcaaatgtcttgaagaacgccgctcgtgcctttttccgcgataagcttttgcagctcaaccgcttccggatcatcctgatagtcaaaacgcaaggcggcggcgatgccttctgccagcgcgttcggttcttttatttttttggccggccctactaatctgtcattcgctccgagttttctgagcggtgatctggcgactcttgtcacatcatccgtgatgtattcattttcaaagcggccgatgatttttttcatgtactgctcgtgttcggcttgcttaaagccgtacgctttcactaagtactcgcccgtttctgaaagtgcatcgtacacgacacgccggatttccggatggccgatggcctctttgacagtttttaatccgcgctgatagccaacgtacgccgtaacggcatgaccggtattgacggtaaacagctttctctcgatgaaaggcgtaagatcatccgtaaacaacgcaccttccagtaccggctggccgccggcaaagccggttctgtctatgacccattcaaaaaacggttctacggatactttcagcggatcttcatggtgctgaatcggcacgatccgatccaccgcagaatccgggaagccgaccgtccggttcacgaattcccgctccgcttccgtcaaatgtccgaaaacttcttttttcagaaaactgctgccgccgatcatattttcacaggcaatgatattgagaggctcagaggacgttctgcgcttcagcccttccgcgatggacggggcgatgagtctgagaacgttcgggcccaccgccgtcgtaatgatcgccgcttcattgatcagcctgtacagctcttgttcttgcaccgcgctgttgatggctgaaacggggccgatgatttctgtctgccggccgccgtcggcaagctccacggtatattccttcttttcattgagaaggctgaccatcgtttcattcacatcagcgaaaactacctcatagccggaatgatggagcagggcgccgataaagccccgcccgatgtttcccgctccgaaatgaagggcaatcatgtcagttcacctcgctgaaaatagcggccagttcttcttccgtctttgcactgatcagccgttcgatgttttcttcctctgagcagatgatggcgatgtttgacaggatgtctaagtgttcattgttttttccggcgataccgaaaacgacctttgccgtattgccttcaccgtattccacaccgtccggaatctggatgacggaaatgcctgaatgaagcacctcatccttcgcatcttccgtgccgtgcgggatcgcgatgaaattccccataaacgtggatgatgtttcttcacgttcgaacattttttccacatagccgttcttcacgtagccgttatcaatcaatgtctgtcccgcgaggcggatggcatcctcttttgagttcaccgtctggttcagtttgatgttcgctttagccaatacttccatgatgaagatccctctttctgttgattagtttttaagcttttcaatcagttcatcgtatttcgggctgttcaagaaattatcaaccgaaatgtgcaccgcctgcggcagcttcgctttcgcgcggtcagtcaggtccttatgcgtaatgacgatatccgcgtcattcggaagattattgatcgacgtatttgtcacatcaatatccaggtctgcttttttcactttgtttcttaaaatggaggcgcccattgcgctcgatcccatacccgcgtcacacgcgaagataatgcggctgacttggtcggcggaaatatcagcggcgctgttttccggctcttcctctttgtccgccaacgcggccgcagcttcgcttttcctgcctttcatttcctgcattttttccgccgcggctgtcaaatcttcttcgcccgctttagacgatttcagaataagcgccgagacgataaacgatacggccgcggcaacgatgacgcccgccagcacgccgagatagcttcctttcggcgtcagcgccaaaatggcgatgatgcttcccggagatgatgcggcgacaagacccgcgttaaagatcgagaatgtaagcagtccgctcgctcccccggcgatcgccgcgaggatcagcatcggtttcattaaaatgtaagggaaatagatttcatgaatccccccgaagaaatgaatgatcgccgctcccggagccgtcgatcttgaagagcctttcccaaagaacatatatgccagtaaaataccgagtcccggcccggggttcgcttccactaagaacagaatggatttacccgctttggcggcctgctcgattccgatcggacttaaaatgccgtggttgatcgcgttattcaggaacagaactttcgccggttctacgaaaacgcttgcaatcggcagcaaattcgcgtggacaatgacttccacacctgccgccagcaatttgttaagagacaggacgaccgggccgatcgcataaaatgcgataatcgtcagcacagctccgataattcccgccgtgaagttgttgatcagcatttcaaaaccctgtctgactttatctttaaacacacggtctaattgtttaatgagataaccgcccaaaggccccataatcattgcccctaagaacatcggaatgtccgctccgacaatgactccgatggcggccgtcgctccgacgactcccccgcggtgatcgtaaatcatttttccgcccgtatatgcgattaaaagcggcagtagatacgtaatcatcgggcttaccaatgtattcagctgcggattcggaaaccatcccgcaggaataaacagcgcggtgataattccccatgcgataaatgcgccgatattcggcatgatcataccgcttaaataactgccgaaccgctgtatcttcactttcatgccagcttgctgttcttgctgcatgttcattccctccctgtttgcttgccttcagatgaaaataaataagacacggggtttctctctcccctgtgtcttcatcataaaacgcttacaatccccattcaatgaaaagtaaagaggagtttggcacagagactgtgacaactccttaacaaaaaaaagacacctcatcaaaggtgtcttaccgctttctgtatataatgtgtccttttgtgacgacgagtttggcaatgagccgctcactgacaataaacaccggatacgcacatacgagcgcgaaaatggcggccggcacataccgcgctgccggaaacatcggcatgacggcggttctggccatctgcacaagataaatcaaaagcaccgtgatcgcaatggccgcagccataatcggagctgatactttatattcacgcaatttcacatggcaatgcccgcactgaaactggcacgggatcatggatgatctgaccatgtcgcctgtaatcggcttgccgcagttcgggcaggtcgtttctttcatgtttattcctccattcaactcttctattataacagagtctgactacgtcttttacatttgtgattgttcaacattttttcacatattttatcatcaggctcttgtgtgcatttgtgaaaacatctactcttagagggaggttcatcactcattcgcataaaaaggaggatgcagaattgcttccgattcacagacagcaaaccttgcttgaatggctgaaagaagagggcgcgctgaaaatctctgacataagcgagagattcggcgtctccgagatgaccgtgtacagagacgtcaatcagctggcggatgcaaaccggattatccggacacccggcggcattacgctccctcccgcttcagaacgaagcgccaatcaatgcggctattgcctgcggccgattcagcattcgtattctgttcagcttattaccgtttcacaagccgttgagcagatgtgctgcattcattgcgcgattttgcggtatgaggataaaaaggaagaagtgtcccacgtcatttgtaaagattttcttctccagacgacgctgacggccgcttccgcatactttttagtccatgccgatattgaccttcactgctgccggcctcaggcgattcccttctcaacgcttgattacgcagaacggtttcaaaaaggattcggcggggtcatttgcacctttgacgaggcggcggacatcatcttacacgacaggcagaagggatgcacctgcagcaagacataacaacaaccaaccggaaggcggtgtcatcatccatgagacagaacaaacgctggctcatctttttgctgttccttgttttgattccgaaaacaagcttcgcccacgcctacatcacaaactcaaatccgggtgagaacagcgaattaaaacaagcgccgaagcagattgaaattgagtttaatgaacagattgaagaaggcttccactccattaaggtctataattcatccggcgaacgggtcgatgcgggaaaaacggtgattcaaaaaaatgatgcccgcatcatgaccgcggcattgaaaaaaaatctgccgcatgatatttacagagcggaatggaacgcggtatcggccgacggacatccggtatccggcgtcatccctttcagtatcggaaaagccggcggagaacttcgggagcagacatcatcgcaagcggcgcttcatcccgaagcggccatcgaccgcggtattttgtacaccgctctctccctgtttatcggcacggcttttttccatctgttttggtacagaaataataaagattcatcaaaagcaaaacgaactgtaaagctgctcgtgatttctttatgtgtaacggggctcgcgcttatctgccagctcccgatccagacgaaagaaaacgcgggcggcgcttggagcgccgcgttccagccggactatgtaaaagaaacgcttctgaaaacggcaggcgggtacgtctggatgatccagattagcttatttatcctgctcgccctgtccatgatcccgctgttgaagaagaaagcattccggtcatttgcgtactggacggcgccgctgttgttcttcttcgcttcgcttttggcaaaagcattcgccgggcacgcggcggtcattgacgaaaaagcggtcggcatcgcgatggactttctccatttatcggccgcgtctgtatggatgggcggtatcgccgcgcttgtgctgcttctttcatcagagtggagaaaacccgataaaaccatcgcttgggaaacggtcagacggttttctccttgggcgttcgcctctgtcggtgtgctgttattttcaggtgtgctgaacggatttttcattatccgcacgtttgattcactctttcacaccgcttacggtaagacgctccttttgaaaatcggactgttcgtcatcatgcttgtgctcggcgccgttcacgtatggatgacgaagttcagcagaaaaaggagcatcagcgcaacgataaaggccgaatgggcactaggcatcgcggtattatttacaaccgccgtcttcacaagcctgcccagcccgccgccgcctgcgccattgccttttaacggctcagaaacgatcggaaacggggaaaccctgtccttgcacattacgccgaaccagccgggtaaaaatgaatttcaagtcattgtcaccgatcacaacggcagcttggtaaaagacattcagcaatttacggtcactgtttaccagacgggcttcagcggcaaacagcatgaaagcacctttgatttgaagaagacgaaggaaggcacattcgaagccgctaacctgtccatcaccgaaaagggaaactggaagatcaaagtccacgggctgacaaacgattttaatgaaatcaaccaaatattctcaacgacaaactaaggagtgtatctcatgttgaaaaaaaaggctttattattcatatccgccgtgaccctgtcactcgtcggttttacggcgacagcaagcgcccacgtctcagtcaaacccgcggaatccgcggccggttcctgggaaacctacacgatgaaagtgcctgtggaaaagaatgagccgacaacgaaagtcgtgctgaaaatgcccgccggcgttgaatttcagcagtatcagccgattccgggctggaaaacattcgtatccaaacatgatgacaaagcggtctccgtcacttgggaagcaaaagacggcggcattcagcccggccaattccagcagttcacgttcgttgcgaaaaatcctgaaaagagcggagatgccgcttgggacgcttaccaatattacaaagacggcagcattgtagaatggacgggtgatgagaaagccgacacgcctcactcgattacgaaaatcacgaaatcggccagcgtgacggatgcgcacggagctgaacagtcaaacgtagaaagcaaatccggcgtatcagcgcttgatattgcagccatcgttctgtcagctgcggcgattatcctttccatcgcggcgcttgtaaagaaaaaacgcgcgtaagcaaaaagcgatccggctctaaagagcctgcgatcgctttttttcttatccgcggcctgcctggaatgacggatatttggtcattcccccgtcagcaaacagcgtaatgccggttacgtagcttgattcctttgaagcaagccagacggcgacagccgcgatttcttccggctcaccgatatatcccatcggaatcatgctttccacatcttttttctgaacgggatccgcaaatttttccgcgttgatcggcgtattgatggctcccggcccgatattgttaacacggatgcgcttcggcgcgtactcaagcgccagcgtttccgtcatcaatttgatgccgcctttactcgccgcgtagtgaacaaacagaggccatggaatcatttcatgtacgcttgacatgttaatgacgtttccttgaatatcattctctacgtaatatttaatggcttcgcggcttcctaagaaagcgccggtcagattggtattgatgactttgttccagtctttgagcggcatttcatgcgactgaaccggattttccataccggcgttattgatcatgacatccaatgtgccgaattccttcaccgcggtctgcacgatgtttttgacatcttcttcttttgtgacgtcgccttgaatgatgaccgcttcgcctcccgctttttgaatctcttctttaacggtttgggcgtctttttcattactatagtagttaaccacgactttcgcctgctcctgtccgaagcggatcgccatcgcttttcctaatcctgatgaagctcccgtaatggcaacgacttttccttttaaatccgtgtacatgttcaaacctcctgcatttgttatgaatttgatttcgcaacgcctaagaataccgcggccacaatgatcaggataatcccgatggcaatggcgaccagctgacgcttcgttttgctctcacggagaatgaagattccgccgagcgtgctgatgacgatccccatttgagagagggaaaaacttgtcgcaactccgacgcgcggctgtgagatgaacagaaacatattcccgagcgcccagatgattcccggcagaatgttcttgagggcgtacttattaaacggtttatgcttgtacgtcaggagcagtccgccgatgaccatcccgatcgcctgcggcaggagcgctgaccatccggatacgccgaacagccgggccacaacgacatagaccaaataaccgagcgtggagatcagcaggatgacaatgcctttttttaagtttcccggttctccgtccgcccgcccctttttatcttctaaagatgtgagcacaatcccgatgatgataaaaataagggcgagaatacccagcgtaatcgcgatcggggttgaccattctttgaatacgatcacaccgaacaaagaagtcgagacgagctgcattcccgttgatatcggcatcgtttttgaaacgcccatcagctgtatgcttttaagctgattgctttggccgagtgaccaaaacagccccgagatgatgccgacaataaaaatgcgcccagacagcaccgggtggacaaacagatacaacacaaacgaaacgatgagcgccccgattgtcgttcccagcgtctggctgtaaggcccgccgcctaatttgacgttaaataacacgatgctcccccaaaataaagccgggagaagagccaataatatatccatgatggcgaccttctttcaatcgtatttgctgttattttgtctggaatcgaaccgattattcccgcaagatcaaaaaagcctgccggcgatattcaccggcagactgctcaataaaaacagccccgcttagaagcggggctttcttttcggctcattaaagtccgatagacatgtatttggtttccaggtacggctcaatgccttccgtaccgccttcacggccgatgccgctttctttcattcctccgaacggcgcttgaaccgcggacggaccgccgtcattccagccgatgatgccgtattcaagctgttcagaaatatagatgccgcggcggtagttttctgtgaagaaataagccgcaagcccgaacggcgtatcgttcgcaagcttgatcgcttcatcaatatctgagaacgtaacgatcggcgcaaccgggccgaatgtttcttcatgcatgatgttcatggatgtatctacatttgacagcacggtcggtgtcacgaaatagcagcctttttcatcgttttggtcatacgttccgcccgtcagcacttttgcgcctttttccacggcgtcattaatttggccgacgattttatcgaagccttttttgttgatgacagggccgacgtttacgcctttttcaagaccgtttccgactttgagtttcgcagcttcttcactcagttttttcgcaaactcgtcttttacggattcgtgtacgatcagccggttcgcacagacgcaggtttggccggcatttctgaatttagaggccattgtttgggctaccgccagttcaagatcagcgtcttcatccacgatcagcggcgcatgtccgccaagctccattgacatatgttttacggtgtcggcgctgtttttcatcaggattttgccgacaggcgttgagccggtaaaggtaattttgcggattttcgggctgctggtgaagacgtttccgatttcggctccgtcaccgatcaccacttgcagcacgtccttcggaattcccgcttcatatgcgagacgcgcaagggcgtaagcggaaagcggcgtatcctccgccggtttgatgatgaacgtacagcctgccgccaaagcgggcgcggcttttcttgtaatcatcgcattcgggaaattccacggcgtgatcgcggctaccgggccgaccgcctgacgggtgacgacaatccgtttgcccgttgtcggcgcaggtactgttctgccgtaaatccgttttgcttcttcggcgaaccattcaatatagccggcgccgtataaaacttctccgaccgcttcttcgtacggtttgccgttttctttcgtaattaattccgcaagttcttctttattttcaacaatcagctcataccattttctcagcagtgaggcacgttctcccgctgatgttttggaccatgattgaaacgcttgatgtgaacgttcaatcgctttttcaacatcttcggccgtctgctgggggatgctttcgatcgcctctcccgttgccgggttgtacactgttaattgttctggcatattgaacattcctttctctgctatagtaaagccattgaatgctagttgatgtatctcacactttcatgatagcagacacatccgccggcattccaataattgaactcacagagctgcttcgataatggaaaggccttctttgagctgctcatccgtcacgacaagcggcgtcaggaatctgataatgttgccgttaatgccggccgtcagcagcagcagtccgttctcgttcgccgttttggcgatcgccgcggcttttgctttgtccggttcccgcgtgtccggatctttgacaatttcgatggccgccatcgcgccgagtctgcgcacttctccgatgcaggcatgctcttttttccactcgagcgcttgatgctcgatgatccggccgatctcctcggaacgctgattcagcccttcttcttcaataatatccaagaccgcaagcgcagccgcacagccgagcgggcttcccgcatatgtgcccccgagttcccctggcgcggcggcatcaagcatttccgcccggccgatgacgccgctcagcggcaatccggccgcaagtgatttggaaacggtgatcaaatcaggaacggccccgaaatgttcaatcgcaaaatacgttcccgttctggcaaaaccggtctgaatctcatccgctacaaaaacgatgccgtgttttttacaaaaagcggcgacgtgctgcacgaaacgttttgacggaatgatgaagccgccctctccctgaaccggctccatgacgacacaggcgacggtttccggtgcaactgcggcgataaagaaatcctcaaaagcgctgatgataaagtcgtcatactgctcgtcgctcatgccggccggcttttgataataataaggaaacggcgcctgatacacctctgaggcaaacgggccgaaaccgaatttataaggcttcaccttgctcgtcatgctcatcgtcatgttcgtgcggccgtggaaccctcttgtaaatgacacgacagcctggcgcttcgtatattttctggcgattttcacggcgttttccaccgcttccgcccccgaattgagaaaaatcgcttttttcgcatgatctcccggcgcaagggcgcaaagtttttcggccagctcaatataagacggatacatcatgacgttaaatcccgggtgaatcagatcctccgcctgtttcttcacggcctccaccactttcggatgggaatggccgacattcagcgttccgatcgctccggcaaaatcaatgaatcgtctgccgtccaaatcgtacaaaagcgccccttccccttttaccgccatgctgcggtttccgttgccgacccccttggaaacgaattgatcccgtttttgctgccactgggcagttgtcacttccgatgatgctgttcgactcatagattccatccccctgcattgttttcttatcattctgacttctttttggtatgatgaaaagtaccaaaaccaatttatccatggtatcagaaaggggcagggtctggatgctgacgatttccattgaccattcggaaacggcggattatatctatcagcagatctatcagcacataaaagcggccgttttaaagcgcagcctgatgcctcatacaaaggtgccgtctaaacgggagcttgccgagacgctgaaggtcagcgtaaattcagtgaattcagcttatcagcagctgctttcggaaggttatttatatgcggttgaaagaaaaggctttttcgtggaggaaattgaaacgtttgatcatgaagaaacgccttcgctctcattgcctgaagatttaaaagagcgggagacggataaaagcggctggatttcgttttctcatatgagcgtggatacggcgcattttcccctgaaaagctggttccgctgtgagcagaaagcagccgcccattcatttcatacgctcggtgaactcgtccatccgcaaggcttatatgaagtgagggcaacaatttcgcggcttatttctctgacaaggggcgttacatgccgcccggaacaaatcgtgctcggggcgggcacgcaaatgctagtgcagctgctgacggaactgatgccaaaagacgcgctgtacgccatggagaatccgggatatatgagaatgtaccggctgctgcaaaacctcgggaaaaaggttgcgacgatcagccttgatgaaaaaggcatgtccatggacgaaatcgaaaaacgccggccctctgtattgatcaccacgccttcccatcaattcccctcaggcgtgatcatgcccgcttcccggcggattcagcttttaaactgggccgccgaacagaacggccgcttcatcattgaagatgattatgacagtgaatttaaatatgacgccgatacgataccggcgcttcaaagccttgaccggtttcaaaatgtcatctacatggggaccttttcaaaatcccttttcccaggtctgcgcatcagctatatggttctgccgcccgggcttttgcggacgttcaaagagagaacgtatgacctgcatacgtgcagcacgcttgcccagctggcgctgaaagaatttatcgaatcaggtgaatatcagaaacatattaaaaagatgaagcagcattataagaacatgcgggaatgcctcatttcggctttggaagaaacattcggaggaagaatcagtgtaaagggcgccaatgcggggcttcattttgtcactgagtttgactgcgcctgttcagaaaaagagattttggcacgggcggatgcagaacagctcgatctgtttgcgatgagccggttccgtctgaaagcgggaggcgattcaaataagccgcagctcattctggggttcgcccgcctgaaggagagcgatattcaagaaggcgtcctcaggctttaccgggcggttttcggcgcataaaaaaacccccggaattcggggacttatttaccagcggtccggctctgtctgcaaaatcgcctccagcaggccgggaaacgccgcttgtaaatcatctttgcgcagggaataataacggtgcttcccgtctatacgtacttgggcgacccccgcttcccgcagcactttgaagtgatgggacagcgttgatttagcgacccggacatcagcgcaggttccgcacgttttttctgttgtttccgccaattgtttgaccagctctaagcggagcggatcactcagagcatgaagaacctttgtcagctgtaagcgttcggtttcaggatggtttggaatgttcatgagtcaaatgtaacacagatcatcggcgggtgacaatttaggcggtgagggtttttcctttaccattcgcagcgaaacatgttacagttagttcgatgatattcgaactataacaaataaacccaatcaggaggaataacaatgatcgtcttacaggcttacatgaaagtaaaagcggataaacgcgaggaatttttaggagaagcacaatcacttgttcagcattcacgcgcggaagaaggaaatgtgcaatacgatcttttcgaaaaagtcggtgaggaaaatacattcgttatgcttgagcaatggaaagatgaagaagcgatgaaattccacaacgcaactgaccatttccaaggattcgtggcaaaagcaaaagaagtgctgagtgcgccgcttgacgtcgtccgcacagaactgtcagagtaacgaaaggatgaatgacatgaacgaagtccttcaattattaacagaccaccgttccatccgcagctacacagatgaacctgtatcggatgaacagctggatcttatcatccaagccgctcaggcagcgccgacttccattaacggccagcaatttaccgttattgcggtgaaagataaggagcggaagaaaaaaatatccgaattggctggcggccagccgtggattgagcaagcgccggttttccttttattctgcgctgattttaaccgcgccaaaattgcgcttgaagagtataatgatacaccgcttgagatcacgaacggtttagagtccgtcttagtcggagccgtagatgtcgggattgcgctgggtacggcaacggctgcggctgaatcaatgggactcggcactgtgccgatcggcgccgtgcgcggcaagccggacgaactcattgaattgctgaaacttccgaaatacgttttcccggtttccggtctcgtcatcggccatccggcagaccgctccgcgaaaaaacctcgtctgccgcaagcagccgttctgcatcatgaaacgtatcaagaagaagatttaagaacacatatcgaggcctatgacaagcagatgtccgaatacatgaaaaaacgcaccgacggacaggaaacgagaaactggtcacaaggcatcacctcctactataagcagctttattatcctcacattcgtgaaatgcttgaaaaacaagggtttaagacggataaataagcggatcagcctgccggaacactccggcaggttttttctatttctcaaacaaaagcgttgacactgtgtaaaaatttttgttaatattttcatcatatactcattggttttctgtgaaccgatgggttttctattgtgacgaaagaaggaatctgggcttatgaatgataagaaaacggatattctgctggcggcaagaaagcttttttccaggaaaagcttttcgtcggtttcgatgcaggcgatcgcagaggagtgcaaagtctccaaagcatctttatataagctgtttgaatcaaaggaagacctgctgttggagctgctcgactttaaccagaaacagatggtagccgccgcttcattattgaatgaagaaacaagcctctcccctgaggaacggtttgccaaaaaactgatggctgagcttgaaggcttcaggcgcaatcagcagttttttaatatgctgatgtacggaagcccctcttccattaatgagcgggtaaaacggcatattcacagggcccgctccacctttatctgctggcatcgcgattcactgattcagacgtacggcgaagacattattccttatgtatgggagctggtgatcgtcctgcaggggctcctgagagaatgcatcacgctgattaagctggaaaaagaaccgctcgccctggagccgctcacggagtttatcatccgccatctcaatctcatcgtcgaaaacaggacaaccgaaaccgcattgcctcaggagatgattgacctttatatcgcctccgcttcctcatttgagccgaaagacaaaaccgtattgctggctgaaagcctgaaggaactgaaagaagcggtctcagcccttccggaggaaaaatatgacgccgcaggactcgcttccgcggcggctatgctggagaaagaatcagcggacaaacagccgcgggattttctcatcaaagcgctcatcggttatttggagcaggccggaccgctgcaccagccgcttgcagccgttaaaacattgctcaaactataaagaaagaaggaatcagcttgaataagagtattgaaactgcaccatacaaccgctctgtcattgtcgggattcttttggcgggagcgttcgtcgccattttgaaccagacactgctcatcacggcgctgccgcacattatgaatgacttcaatatagacgccaacaaagcgcaatggctgacaacatcgtttatgctgacgaacgggattttgattccgattaccgcgtttttaatagagaaattcacaagccgcaccctcttgatttccgccatgagtattttcacggcgggcaccattgtcggcgcattcgcaccgaactttccggtgctcttgacggcccggattatccaggcggccggtgccggaattatgctgccgctcatgcagacggtatttctcacgattttcccgatggaaaagcgcggccgcgccatgggtatggtcggcttggttatttcgttcgcgccggcgatcggcccgacgctttccggatgggcggtcgaagcattctcttggcggtctttgttttatatcatcttcccgatcgcagtcatcgatttgcttttagcgattattctgatgaaaaacgtcacgacattacgagaaacacagattgatattttatccgtggtcttatcgaccctcggattcggcggtctgctttacggcttctcaagcgccggttcatcagggtgggccagtgctgaagtgctgacttcgctgcttgtcggagcggtcgcgctgattttctttatcgcaagacagatgaagctcaaaaaaccgatgctggaattccgcgtgttttctttcgggattttcagcctgaccaccctgctcggaacgcttgttttcgcgctgctgatcggaacggaaaccattctcccgctttacacgcaaaaagtccggggcgtatccgcgtttgataccggattaatgcttttgccgggcgcgattgtgatggggatgatgtctccgtttatcggccgggtgtttgacaaaatcggcggaaagggccttgcgatgaccggattcttcatcatcctgctcacgtccctgccgtttatgaatctgacggactcgacgtctctcatttggattgtcgtcgtttataccgcgcggcttttgggaacagccatgattatgatgccggtgacgacagcgggtatcaacgccctgccgcgccacttaattccgcacggcacagccatgaacaataccgtccgccaagtcggcggttctatcggtacggcgctgctagtttccgtgatgagcagccaggccgcgcacgcaaatgcgacaactccggcaaacgccgccctgcacggcatgaatgcggcatttgtcgtagccgcctgcatcgcgctggccggcttcctcctatcttttatattgaagaaaaaaccgcgtcagcccgagcagcagcaggccgttacgcggtaaaccaaaaagaacccgatcacgtatgtgaccgggttctttttttacttctcgattccgtctttaacttctttcaccatttgcgccatggattccaggccgcctcctgataaataccatgtagctgaatcaaggtagacaacatggttgttcttcacggctttcaccgattttacataatcattttcaaccacttgttttgttgaagattttgtgccgatcgctgttccgcggtcaacgacaaacatgtaatcagggtttgttttggcgatatattcataggaaatgctttgtccgtgcaatgaggcttcgatgtttttgtcagccggtttgacgccgaacacatcatgaatgaagccgtatcttgatttagatccgaacgcgctgattttgccgtcgttcgccatcaccactaacccgtttttatccgtgctgcttgtctttttcttcagatccgcaatggatttgtcaattttcgcaagcttatctttcacttcattttctttgttaaagattttgccgatcacttcggtgttgtgcttgaatctgtcaacgtagtttgtatagtcatcatcaagataaatcgtcggcgcgatttttgagaactctttaaaagaatcagattgtctgtgggcgataatgattaaatccggatcaatatccgcgactttttcaaaatccggttcttttaaaccgcctgtattggcgtatttatcacttttatatgaagataagtattttggaaggttttgtttcggaagtcccgccacatgatcctgtaaaccgagttcatccatcgtgtccagcattccgaagttgaatacgacgacttttttcggattcttcggcactttgacgccttctttgttcaggtcatctttgattgtgattgtttcttttgatttgcctgatgttttgtccccgtttccgcatgcagaaacaacaaaaatcgtaacgagcgcgatgaatagcagcgcgaattttttcataattttcacctcatctggtttttaagaaaagtacacaccgatccgctgactgtcaatctcttgaatcgggatggtcatatcataaatatcttcaagcacggaggtttcaatgatctcctccgcaggcccttctttgacgatccggccgtttttcagtgcgacgatatggtctgaatatacggatgcgaagttgatatcgtgaatcactacgacgaccgtttttccgaagtcttccacaagccgcttcaacagcttcatcatttcaacggaatgcttcatatctaaattgttcagcggctcatcgagaaaaatatagtccgtatcctgagcgatgatcatcgcgataaacgccctctggcactggcccccgctgagctgatcgagatatttatcctttaagtcatccagcttcatataactgagtgcctggttgatatgcacccaatcttcatccgtcagtttcccctgggaatacggaaatctgccgaagctgaccaggtctttaatcgtcagcctgatattgatttggttcgtctgcttcaggatgctgattttttttgccagatcgttgcttttacaggccccgatctcttgcccgtcgaccgtgatttccccggaatccgtcttaatcagccggctcatgatagacagcagcgtgctttttcccgcgccgttcggaccgataaatgaggtgagcctgcccttttgaatggatagagacgttttctcaaggacggttttccctccgtattgtttgcttacatttttgacctctaccatgatttattctcctttaacagcagatagataaaataaatcccgccggcaaaattaatgatgacgctcagcgtcgtggaaaacgtgaacactttctccacgacgaactggcccccgacgagcgcgacgatgctgatcaggacagaacctgcgattaaatacgtgtgcctgtaggtttttaaaaactctctcgccagattgacgacaagcagtcctaaaaacataatcggtccgacaagagccgtagagacagacacaagaatggcgacgacaatgagcatctgtttcacaagcttatcgtaatcaatccccaggttgacggcgtgctccctgccgagcgacagcacgtcaaaaaaccgcgtgaaccgccagacataaatgcccgtcagaagaaagacagcaccggcaaaccataaaagatcggtgttgatattgttaaagctggcaaacattttgtcctgaacaacctggaactcattcggatcaatcagcatctgcataaaggatgacagactgttgaacagcgtgccgaacacgacgccgacaagcagaaggaaaaacacgttccgcccctcgcctttaaacatgagctgatacaaaacgagtgacaagagcaccatcagcccgacggagatgacgaaattaagatttttgttcatcatgacgatattcattgaaccgaacaggaacacgatgacggtctgaatgagcatatacagggaatcgaggcctaaaatgcccggtgtcagtatgcggttatttgtaatcgtctggaagatgaccgtcgaaaacgcgatcgctcctccggtgagcatcatggcaagcactttgaagcatcgtctcggcagggagtattcccaattgcccagtccgtagaacaggaagaatccgatacatatcatggcgagcgccgccagcagcgtaatttttttattatgactcatatgcttttctccttaacagcatatacaggaagatgccgctgccgataacaccgaccatcaggccgatggaaatttcgtacgggaagataatcactcttcccaaaatgtcgcaaaacagcacaaaaacagcgcccagcagagcggtgtgaggcaggctgctcctcaggttgtcccctttgtaaatcgacaccatattgggaatgatcaaaccgagaaacggcagcatcccgacggtcaggatcaccagtgaagcgatgagcgacacgataatcagaccgatattaacgacgcgtttgtatttcaggccgagattgacggaaaagctctctcccattcccgccaccgtaaatttatccgcatacacataagcgatgatcaccagcgggatactcagatataaaagctcataccggcctttgacgaccagtgagaaatctccctgcagccatgatgacaggttttggatcagatcgtatttatatgcgataaacgtggcgattgagctgacaatattcccaagcattaaaccgacgagaggaataaaaatcgcatcattgaacttgattctctcgaggattttcatgaaaaggaaattccccgccaacgcgaaaacgaaagcgatagacattttcacaagcggactcgctgacgtaaaaagcattaatgaaatcaaaattccgagccttgcccagtccatcgttcccgcagtcgtcggcgatacaaatttattccggctgatctgctgcatgattaatccgcagatgctcaggctcatgccggcgatgataatgctcaccaaacgcggcagccggctgtcaaacaatgtacctgcctgttctttatttaaatgaaaaatatccagcggcgacaaatcttctacaccgataaatatagaagtacacgccaaaaccgccagtagcaaaagtaagtaacgtagcttcatgctgcctccctgcacccatcacaaacggtatgactgattgccaaacaactcccatatatcccactcgtaatgattatcattatcaacgacaattataatcttatcatctttccaagcgcagtcaatacagttttgctttcaaaagcggtcatccgcgggccgtacactaaattgtcttacaatcagtctatcaagaatttgcaggattttctataacctacatttggctgcttatcattttttgcacatgatgacacgcttgagggaaacaaatctgacaaacagcggcaaaattcctccatgaaaatacaaatgttctccccacgtagaaaaaatccttgatttacatgtttgaaagagagataataaaaattaaatttgtgagaaaatttaaatattaggggatgtaaatcatgaaagttgtaaaattcggaggcagctctcttgcgtcaggagcccagcttgagaaagtgtttcaaatcgtgacggctgatcccgcgcggaaagccgtcgtcgtatcggcaccgggaaaacgcttctcggacgatacaaaggtgacggatctgttaatccgctgtgcggagcattatttgcaaaaaggtgcagcgcccgagcttgccgaaacggtcattgaacggtacgccgccatcgcgcgtgagctgaacctggatttctctattatagaaagaatccgcagtgacctattcgctcttttaaacagctgtaaaaccaatcccgaacaatatatggatgcggtgaaggcgagcggcgaggacaacaacgcgaagctgatcgcagcctacttccgacggcagggcgtgaaagcggaatacgtaagtccgaaagaagcggggctgtttgtgacgaatgaacccggaagcgcgcaggtgctccccgagtcttatggtcatttgtaccgtctgagaaaccgtgaaggcttgatcatttttccgggatttttcggttacacgaaggagcatgagattgtgacgttttcccggagcggttctgatattaccggctccattctcgccagcggcttaaaagccgacctgtacgaaaactttactgatgtggacgccgtctattccgtcaacccgtcaatcgtgcggcatccgaaagaaattaacgaactgacgtatcgggaaatgcgtgagctctcctatgccggattttccgtttttcatgatgaagcgctgattcccgcatttcgggccggcatccccgttcagattaagaatacgaataatccggatgcgaaaggaacacgcgtcgtcagcagccgtgacaatacgaacgggccagtcatcggcatcgcaagcgacacgggcttttgcagcatttacataagcaaatatttaatgaaccgggaaatcggtttcggccgcaaagcccttcacattttggaggaagaaggattgacgtatgaacacgttccatccggcattgacgacatcacgatcatccttcggcacaatcagatggactcagaactggaacacaggctcgtcacccgtctgaagcaggaacttcaagcagatgaagtcacagtcaggcacaatctggcgctgattatggtcgtcggggaagcgatgcgccataatgtcggcacaaccgccagggcatccaaagcactgtcggaagccggcgtcaacatcgagatgattaatcaagggtcatcggaagtcagcatgatgttcggagtgaaagaagaacaggaaaaacacgcggtgcgggcactgtatgatgaatttttcgccggagtcttactctcataggacaccgcctcttttttctcttgtccactaatatcccttacaaagcagcttcttttacatattgtatggtatagacaatatggaggtgaagctcatgtcaggatattctggagtcagctctttcgctttgatcgttgttttatttatcctgttgattattgtaggtactgccttcgttggcggtttctaaacatcactccgtctatatgaggacgctgcgggttttgacctgcggcgttttcttttgttttccgccgctgtccaagtccggccgcgcaaaaaagactgccgagaacattctcgggcagtcttttcctttgttctggttattttctcctcacgtcattcctctttcagctacatggaattcagcctgatctgtctggcctgcacctgtcactgtaaaaatcgcggcggctgctaaacaaataacaaaccatttagatttcaatttcatacaaaccctcactcctttgtatttgtttccttgcctcttcgactttcagaaaatagtcagaagaaattttaaagcaattttgttcatagtaatatttagctgcttctagtgctaaatcctctatatcggcgtataaatttttatcttccaggtaacggaaacacgcgctgattgtttcctcatccggtttcgcctgatacagagcctgcagccattcgaattttaccgtataaacgggatcgtctgtttctttagcatattcatatccccgcttgtgatattccgacgctttttctttttttccgagtttaaagtaaatgagtgtgattagaaaatatgcttgaggaagagaattgacgattctttgtgattcaaatgtatcgaccgcccgttcaaagtacggaatcgcttcgccgatgcggtcctgattgtagtagcacagtccgaggttatacagcgccctcccgacaagctgcgctttttgttctttttcggccatttgcagagcgtgctgaaaatgtttggccgcctgttcaaagcgcctttcatccattaaattgacgccgaatacaaaatggcattgaatgatccggacgttatatgtgtcctgctctacgtaaatttcataagcgttttttatatgtatcaaagaaaaatacgtttgtttcatatgataataagcttcggccactttaaaataaaactccgcccgttccacgtggtccgatacgaaggccagttttttctcagcttgtttataatatgtaatcgctgagataaattctcttttatcaaattcaaacatgcctttgaaaaagttgacgtaataatcgagaagccctttgaggccggcctggctgttatcaatgttatcaagaatttccgacagggtcggctggtcttctatcttcagtttttccagcggctccaagtagtccagcatcagctgatggcgaaattccatgagggaataataaagcactaagttcgaatcaggctccatatggtcaagctcttgtttgatctcggccttcaagatctccgcatccggcacgctgaatgttctgatgtatcgataccactcgttaattttctgcccgactgctgaagaaggaattaacccgctcttcattccttcaccctccccatccaagacctgtttaccagttattttatcacgtttccgtctctttccatcccgaaaaacacgcaaactttgtttcggcagagcgcaattttccgagtggagttaaaacaggcggcggccagacgggaccgccggtttcaagatgattcatttttcgtattcagcggaaggcggattgtaaaggtcgtgccttttcctttttcgctgtcaatatctatcgtgcccttgtgcatttcgacgagctgcctgacgatggacaggccgagtccgtattcgccgtatgccgtattcgtccgggacacgtccgccttataaaaccgctcccatatatgctcaatttcttctttggagatgccgatcccggtgtcttcgatttcaatcaccgtttctttatagccttcatacccgcgcagcgtgatgtctcccttttgcgtaaattgaatgctgtttttcgtgatgttgacgagaatctggatcagcctgtcataatcggcgaatactttgacgccgtcctccacttgaatccgcagctgattttgcttttcctccgcctgctgattgagatgctctttaataatttcaaacacctcgatgagcggcagactgagcttgtccagtttgatttgctgggatctgattttttcataatccaggttttctttcacgagcctgagcatccgcttcgtttcttcgctgatcagcgagaagcatttctctttatctttttccgggatggtgttgctgttaagcccctccacaagtccgttaatggtcgtcaaaggcgttctcagctcatgggagacatcggcgataaattggcgcctccgtttttcaaggcggtcaatctgctctctcgattgcttcagatttttggccatgatgttgaaatcggacgccagcatgccgatttcatcgccgccgctgtttttaagagaaatatcataatcaccggatgccacttttccggtcgcatcccgcaatgtctgaatccgcttgacgtgaaatttagataaaagccagctcagcagaatcgtgatgataagggtgctgatgatcgcgtaaaacatatagcggttgacctggctgatcatctgctcgacccctctgacgggagacacgagcagcaccgcgcctttaaattgatcgttgataaaaagcggctttgcgacaagcgatacttctaaaccttctgtattaaaacggttcatctccgctctgatctgaacggttttcccttgcttcagcatgtgccactctttacttttcagcttctcgcgcggcggcatatcgtcaggaaaaaagtaaggccgctgatgttcatcgaaaataataaacctggtctcgcgcgtttttaacatgtcctgatacggatacaggcggcgcagatcaagatcgcggccgttcagctcacttgtgatctgctgggcgtaagatgacagctcatccactttattttgatacgcaaaatctttcacaaagtgcgaaaacagggaaatgatgatgaaaaaggccaaaatcaaaatgctgacatgacttaacagcagctgatataagtatttaatcctcatcaaatttgtatcctaccccccacaccgtgtataaaaacggtttttcctcactggacagttttttgcgcagccgtttaatatgaacatcaaccgtacgttcatcgccgtaaaattgatagccccacacctgctcaagcagctgctctctcgaaaaaacctggcgcgggttttgtgcgagataaaagagcagatcgaattccttcggcgtcagattctcgacaggttttccgtgcagaaacacttcccgcgtcttcttattgattgaaaaacacgccgtttcgatcaagtcgtcgcttttaacggcctgccccgtcgcccggtatcttctgatcaccgctttaatccgcgctactagcgtcagcgggctgaacggcttggtgacatagtcgtccgcccccatttcaaacccgatcacctgatcagactccgtgtcctttgcggtcagcataataatcggcacactgctcgtctctcttattttccggcagatcgtcactccgtccatggatggaagcataatgtccagaatgaccaaatcccagtcctctttcgtgaaacgctgatagccttccactccgtcatggacaaattcggcttcaaatccttctttaaaaaagaacatttccgtcatggtgcatacgcttatattgtcttctatcattaatatcttcattggttcctccgcttatcttcacgctttttcttataatagcaccattttacccgggtgttttcgggtttcacaattgttagtttttatttcatcacccggaaatagtttgttcatatttttttcatacatttctcctactatatacatatcggatggccggtgctaaagaaggccggttttacaagatctgacacccacacggaggaacagacatgaactttataaaaagagccttttggagcatgaaggcaaaaaagggaaaaacatttttgcagctggttgtgttttcagtgatttgcatttttgtcctgtccggtcttacgatccagtcagcggcaaagaaatcaagcgaactggcaaggcagcagctcggcgggagcgtcacactccaggctgaccgccaaaagcaaatggcgcagcagcaaaaagacggtgaaaagaggacgtttgaatcaacgccgatttccgtctcagatgccaagaagcttacatctttacagcatgttaaaaattacaacttcctcacgacagcgtcagcaaatgcagaaagctttgatgcgataaaaagctcaggcgaatcagccgataacagttccggcgccggccgttttcaaggcggcggaagacagatgatttcagctgatatctcgatcgaaggcgtgctctctacggcattgcttgatgatttcacaggcgggagctcaaaaatcactgacggccgcgccatcacaaaaacagatgcggacgcaaaagtcgccgtgattaatgaaacgctggcagatcaaaacaagctgaaggtcggcggctccattaccgtttcctcagcagcggatgattctgtgaaaacgaagcttaaaattgtgggaatctataaaacaacatcatcaggagacgatcaggcacagcattttttattcttaaatcctgacaataaaatctatacgccttacaccgccgcggcggcgttaaaagggtctgataacaaaaacaaaatcagctcagccgtttattatatggatgatgccaaatatattgactcattcgttgcggctgcgaaaaaaacatctatagatgataaaacctacgcgctgacgacaaatgatcaggtgtatcagcaaatggtcggcccgattgaaaatgtcgcgtcattttctaaaaacgtggtataccttgtatccatcgcgggcgcggtcattctcgggttgatcgtgatgatgtcgatcagggaacgcaagtatgaaatgggtgtcttgatggcgatcggcgaaaagcgctggaagctcatcggacaattcttaacggaaattctggttgtcgccgttattgccatcgggatcgcatccgtcacgggcagccttgtggcgaatcagctcggaaatcagcttctttcccagcaggtcagctcagccgatgattcacagcagcaaacaagcggctggggcggcatgttcggtcagcattcatccggcgcggatgtcatcagtacaatgcaggtaaacgtctcgctgaatgaccttctgattcttggcgggatcggcgtcgcaattgccgtcatcgccacattactgccgtctgtatcagtcatgcggcttcaccctaaaacgatcctgaccaagcaggaataagaggaggcagcataatgagcctattaacctttcaacagaccggctactggtaccaagacaaatcacagccgctgttccaggatataacgatcagctttgaaaaagggaagttttatacaattgtcggcgcctccggaacggggaaaacaacgtttctgtctctggcgggcggccttgacacacctaaacagggaagcatcctttataacggaaaagacatctccaaaattggattaaccaaattcagaaatcaatatgtctctatcgtctttcaatcttatcatctgatcccgtatatgacagcgctccagaatgtcacaacggcgatggagatcaccggctctaaggagaacaacaaagatgcgttcgcgctcagcatgctgaaaaaagtcggcatcaccgaacagcaggcccgtcagcgggtgctgacattaagcggcggacagcagcagcgcgtttcaattgcgcgggctttctgctgtgacacggatttgatttgcgcggacgagccgacgggaaatctcgacgaggatacgtcaaaggaaatcgtccggctctttcaggatctgacgcataaagacggcaaatgcatcatcatggttacgcacgacgaacaaattgccaaagtttcggatatcaacatccgcttatcaagaggaagtttcacggtcaaagaaaacggcacggccgtttcctgataccgcgcccctgccagcgcagacaggggcgcaccctatatccccctattcaatagaagtgaacgtaaaaagagcgagggctgcatccccccgctctttttatttatatcagctgtaaataacggtccatatttgattgtccggctgctttgatcaattcttccgcctttttctcttctcccggcaaagcgagccggagtttgtcttcaatgtctttttcagaaagaccgtttcccggcgctcccttcggacagtcgatacgtgtttcatagacatgaccgccggaagccgtgacccgtacaattgtaaaacggcccttcggaacggcgttgtcagccggctgaatttggtcatcgcaactgcggtgaatccgctcaaatcctttttgaagggattccggaatcggctcggatgtgaaatgttcaactgaaaaatccttaccgtgcaaagccaaggtgatcacatattccacgctgaatcttcccgcttcgcctgttttcggacgccgttctgtcaatgcagcgtcaccgcccggcggataaatcacgtcgatccgttccgtttggccgaaagtgagaccatgttcggccttcagcttgagaatggcgtccgccgcatgatgagccgccgaacaaaacggataaaccttaaaccaaagtcccgggctcacaatccgccaaggttttccccacccgcttacaaggagggtttctgcccgttcaagatcgccgtacagtccgaaaaaacctttctccccgtcgagcgcatgaactgagccgccgaaaccggcctttgcaagctttacggcgaacaacccggcttgagcggccagtccggcgtggagcggcttcatttctgtcccgaattgcactctcatgcctccggagcgggcagccgcaaacccgattgctttctgcaattggttttgattcagattctccgcgaatccgacggcgcatgcggccgcaatggcacctaacgttcctgtattatgccagcctttctcgtaatgatgccttccagctgactcgccgagccgcgccatcacttcgattcccgtcacataagcaccgagaaaacggcttttgtctatacggccggctgatgcggctgcaatcaaagccggaaggatgactgcgctcggatgtcctcttacatcagaatgaacatcatcaaaatcaagcgcatgtgcgatgaatccgttaatgagcgcggattgggacggcgtggttttttgatttctgccgataagcggcgctatcggcaccccgccttcttcttcggccagttttaccagcttttcaactcctttatcccgtctccccgcaaaagctgccgctgtaaaatcaagcagtcctttgcgcgcttctttcatcgcttcagcggatgtttccggcacagacgacatgacggcctgagcaagtccggccgtcagattttccgtattcattccgtctgctccaatacgttgacggcaagccgggcgaaaaactcagccgctgccgggagcgctttttcgtcgagtgtgaaggcgggatggtgccattcttccgttccgtttgttcccatccagacgaagaagccggggattttttcttgatataatgcgaagtcttccccgccgggcgactgttctgcccgaacggtttgaagcccgaggctttcagccgtttgttccgccgcctgtatgaaacgggcgtcgttcatcactgacggaaggtaaggataccagcggaaatcagcctctgccccgaatccggctgcgattccttcggcaacccgcttcatatgtttcggaacagcgtcacgcgcttctttttgaaacgtccggacggtgccttccatttcaacatggtccgggatgacattccaagagctgccgccttgaactcttgtgatgctgacgacggcattataaagcgagctgatatttctgctgacaactgattgcaggccgccgatgatctgtcctgccgcctgaatcggatcaatgctgttatcagggattccggcgtggccgccttttcctttaacagtgatttcaaagcggtcgacactcgccatcagcgggccttctttcagaccgaccgtgccgacggggaggtcaggtttgttatgcatgccgaatatcgccgatacaccgtcaagcgcgccggcttcaatgacctgtcttgctccggcggcgatttcttccgcgggctgaaaaataaaccgcaccgttcctttcagctcatgctttctctcatttaataaaaaagccgtgccgaggatagatgccgtatggaaatcatggccgcaggcgtgcatcacgccgctgttgcgcgaagcaaacggaaggtttgttttctcttcgatcggcaatgcgtcgatgtccgctctgacggcgatgacggggccgcttttgtctcctttgatttcagcgatcactccggtttgaagtttcggcacatcaagaaccgtgattccttcttcctccagccagcggcggattttattcgtcgtttcgtattcctcgcctgacagctcagggtgttcatgaaggtcgcggcggatattgattaaacgtttgtttaatgattcatacgtttcatttgccatttcttcttcttcccttcttagacaagttcggcgggctctcccacttgcttaatgaattttttcgtccgttcgttctgcggattgtcaaacagctcttccggcgttccctgttcgatgatgcgtccgtctgccataaaaataactttgtcggccacttcacgagcaaaagccatctcatgcgtgacgatgatcatggttgtctgtttttcggcaattgatttgatgacttggagcaccccggctacaagctcagggtcaagggccgaagtcggttcatccagtaaaatcgcgtgaggatcaacggccaaggcgcgcgcaatcccgatccgctgctgctgtccgcctgacatcgtaatcgggtagctgtccgctttgtgttctaaaccgacttgccgcaacagatccataccgatctgttccgcttcttttttcggtttcttttgcgcggtgatcagcgcctctgtcacattttgcagggcggttttgtttttgaacaggttgtaattctgaaacaccatcgccgtctgctggcgaagcttatgaacgtctttgcgcgaataggacgctgcattcagctttgcatcaccgatttcaatgatgccgtcatccgggcgctccagcagattcaaacaacggaggagcgttgattttcccgagcctgacgggccgatgatggccgtgacttcgccgcttttgatctcaaggtcgatcccgtcaagtacggtaaggtctttaaatgcttttcgaatatgtctgacttgtatcatcctgagcctcctcctatgtgcgataaggcttgctgatcgcccgttcgagcagatcctgcagcacactgtaaataatcgtaagaatccagtacatgaccgcgacggctaaatacgtctcaaaatatttgaggttgcctgatgcgtacatttttccttgggcgaacatttccatcactcctaatgtaaaggcgagcgatgtttcttttaacaggccgataaacgtatttcccgtcgcgggaagcgcgtttctgacggcttgcgggaaaatgattcgtctgtacgcctgggattttgtcattccgacagacagacaggcttcaagctgcccctcatcgactgaattgagcgccgcgcggaagatttcagccaagtaggcggcattcttcaggcttaacccgataatcgccgcagttaacgccgtcatcttgctcattccgggaaacagctgaggcaggccgtaataaattaagaaaagctggacgagcgtcggcacgccccggaaaaatgaaatatacacctttgacagctggtgaagcacaggaacacgattttttgtgataagcgctaatataaggccgccgatcacggcaaataccatggccgcgacggccattagtaatgtgatcggcaaggcttcgattaacgcgggaaaagctgaaaacataaatccccaatcaatgctgttcattctcgattttcaccgccgtttcttaatgctttgcttctgttgtgatatcttctttaaagtacttttcagacagctttttcagcgtgccgtcttttcgcaggtcttcaatggctttgtttacttttttgcggattttatcgtgagccgcatctttcgcaaacgggaaagcgactttttcatagacaatcgggtctcctgctaatttcagaggcagaccggtctttttgatctgggcgatcaggacgctgcggctgtttacataagcgtcaacccgtccgtaagccacgtctttcagcgtgccttcttgtgtttcatacgttttcatattgatttttttatccgggtccttgctctcaaggtttttcgcgtggtttgagcccagaacggccgccactgtttttccttttagatcgttgactgatttgatgtctttgttatcgtttttgacgacgatttgagtgcccgcatacgaatacggttctgtgaagttatacgttttcttgcgttcgtccgtgacagcgacctggttagagatggtgtcgagtttgccggtctggagctctcccatcagaccgctgaattcaagcagcttccagtccagcttcatgttgatttttttcgcgacggcttccatgacatccacgtcaaagccggtcagcttgccgttttctttatatgcgaacggatagctttgtcccgtggcgccgacatgcagtacgttatcgccgccttcgctttcttttccgtttccgcatgctgataagaccgccaaaagcgcggcagacagcagcaaagcccatgttttcttcttcattaaaatcccgccttttcctattaatatgttaatcctgcaattgtttttttaaataaatggtgatgtgcccttttcctagatccttttcgcctgcacggacgtagccttttcgctcgtacatgccgatcagccacggatgcttgtccgctgtgcccagtgacacgaaaggcgcttttaatgtgtcgcggagcactgtattctccagccactccagcatgtctgagcccgtccctttttttccggtttcaggatcgacggcaaaccaccaaatatgtggaacaccgtacggcccgggattcggcccccacggcatccgcagagaaatcgtcgccagaatccggccgtcttcctccaaaacgtaacaggcgtttttttgtatgttattcaaaacgagttctttatccgccgtggcagcggcaaagttgatgccgagcttgcggatcggttcatacgcccgcagtgtcagtgaaagcagctcatcagcgtctgcctccgttgcgagccggtattgtcttgacatgatgagccctccttcagtcggcatatcggtttgccggtttttccagtccgaaatgttctctgagcgtcgttccttcatactcttttctgaacacgccccgttcttgtaaaatcggaatcactttgtctacaaaaagagtgagaccttcaggcaaaagcggcggcatgatgttgaaaccgtcacaagcttgttttccgacccattcttccatcttatcggcaagctgttctggcgttccgacaaagatatgatggcctcttgaacccgccacatatttgtacagctcgcggatggtcatgttatcgcgtttggccatctcctgaacgagcttgaagcggcttttaacggcattcgacgcatccgcatccaattcaggcagcgggccgtcaagcgggcaggcggaaaggtcgacgccgcccagatagttttgcagaatgttcagtccgacagacggaatgatgaggtcttggagctcttcatattttgcctgcgcttcttcttcggtatcggcgataacgggaaaaattcccggcatgatcgcgattttttcaggatcacggccgaaagaagccgcttgttctttaatagattgatagaattcctgcgcggactccaaatgattttgcgcggtaaaaatgacctccgccgttttggcggccagcgcttttccgtctcctgatgatccggcctgaataatgaccgggcgcccttgaggtgtgcgggcgacatttaacggccctctcacggagaaatatgttcctttatggttcaattcatgcattttgcctttatcgaaaaatgctcctgattctttgtcacggataaaggcgtcttcctcccacgaatcccataatcctttgacgacttcaacgaattcttccgcgcgctgatatctgagatggtgctcaagatgcttttcgccgctgaaattaagcgcggtcgattcaatcgaagatgtgacgacattccagcccgcgcggccgttggaaagatggtcaagcgatgcaaattgtctcgcgatatggaacggttcgctgtatgtggtagacgcggtcgccgtcagaccgatgcgggatgtgacctgagcgagcgccgacagcagcgtaaacggctcaaagcgcgtcagcacattcgggtgtgatttgccgtctattgataaactgtccgccaaaaacagcatgtccaatttcccccgctcagccgttttcgccagttctttgaaataatccaaattcatgctcgcgtccgccggtgcctgaggatgtctccaagaagcgacatgatggccggtacccgcgagaaacacaccgagtttgatttcttttttctttgtcatgatggatctccttctattctgaaatacggttcggaacatattaacatgattaaacctatatttcctagtaattttataagaataaatcaaaatgtacaattgtcacgcaagtttgtcaatgcattaagacaaaaatcatgattttttaaaaaacccggcgcatcggccgggttatttcttcgaaactgtatagacggtccctttgacttttttcttaataacggcaatgataagcagcaaaacggggaacagcacttgaaacggaagatgaatataggtcggcacaacttttaagccttcattcatgtgttccgaaaaattgcttgcgatgctgatggagagaatcagcacccccaatccgaccgggaaggccagctgggacggatttttttctttaaaaagcgtggacacgcccacgacaaccgcatatgtaaaaaggctgactttgaaaaaaccgccgatgacgagcacgagcatgaaaaagacatccagccggtctaaaaactcttccactttaattgtctgtatggtgctcagcagcggaaattgagagcggagcattaagttgacgtccagcacacaaatattaatcgccactgacatcgccaaaaacaggccgctgatgataatcgccagaaatccggttttccgcacctttttccgatcctttaagtaaggaaaaatcatgacaaacacgattaattcaccgaacgggatgaacatcgtctgtttaaacacggaataaatgaccgttcctgcaccctccgctaaaacgggctggagaaatctgaggtttatcgtgcctgagctgataatgaggatcagcccgacggctgtcaggaaatacataatgccaaacagcagctcgccggctctcgctatcacttcaattccctttctgaccgcaaatatcgcggcgatcatcagcatggcattcacaattaaaagcggcgtatcctggtaggcgaaggtgacaagcatttcgccaaaatcccgcaatacgcgggcggcgatataagcaaaatagagaatataaagaagggaggccgcccagctcagatgtctgccgatcagttcgttcatgtaatctctcggagaagactcaggaaaaaattgatacagcgcctgataaacgtagaaaagtccgagaccggtaacgcacccgagaagcacggacagccacgcatcccgcccggccatcgtgcccggcgggatcaataacgaactgcccaattcaaacaaaatgatcataataaacagctgacgcgtgccgattttcgcattttccatacgcttcgctcctttctcctcaaatcaatcatgctcaagcttgtctgagagaggattattccgcaagcccgttcttctgataatgacttccgttttgacatctacggggagatttgggaaatattcttcatcccacttccctttgaactttttccatttgtccggatgcttccgatagatcaggtctccgaagccgacgaagtcattcttatgggcttttatatcttcaatcgatttggtgatatctttctcaagctgcacgctgagcgccttttgcatcgttatcagcacttgcggatcagacagatggaaagggtacctgacagcgtccaccagcccctcgacctgagcatgcacgtgaatatgcggttttccgttcggaaaagtggccgtcacctttgtattctggcgggtgacctgcagactgattgcatgcttcacgttcttccaatccgcattgatgaacgtatgcttgatcctattgagcagccatacagcccccacactgtcgtcatccttaatccagtaatccagcctcccatcctttttgaacaccgccagtccgtccgctgacagcactgctttcggttcagttgtctgcgtattttccatcgtagggccggctttatcgtctccgtgcatttcataacccggaataaacggcgacccggccggagaagcgagatcaatcagaacgtcctgaaggctggttttaatgactctgccgtattgttcctgcgtgaagctgagcgtcttgttcactttattggaagggattttatcaatcggcgtcagcactttaataatgtcttcagccttgcaattatgcgcgatcacaacagttgcggtcgtcctgaattcggtgtcgcggtcaagattgtccagaataaaactgagcccttcctctttcgccagtttttcactgaacaccacgagattcgtatgcgcaaaatagagccttctggacactttcatcgagccttttctcaaagcttccgtcatattgtctccggacaccgaatagacggaaaccggaggccggtctcccgctccgccgccctgcagaccgccggccacgtttcccggattgataatttgcaagtgaaggacgtattttcccgtttcggtccggtcaataccgatggcggagatcaccgctaaatcggtcagctcccttttatcccagcatccggatacaaacataagggaaaccatcgtacaaaggataagcatccatttacgtcttttcattaccgtcgccctcttctacatctttattaaccattcctctggatgtctccggtttcggtctttgatgttccccttggcgcctgttgttttcctgcacgagcagtcccggccttttttcatccgcccataacggggcgcggagaagggaatccttcagcccgcccggggttaaaggagcgagcggggacatatacggaaatccgaatgaacgcaggccgcacagatggacaaacatcatgataatgcccagaatcagcccgtaaaatcccatgaccgccgccgacagaataaagagaaaccggatcagccgcgcagatatcgccatgtcaaaagccggggtcgcaaagctggcaatcgccgtcagggcgacgacgataaccatggctggggaaacaatgccggcctgtacggcggcctggccgatgacaagcgctccgactatggaaacggcggagccgacaactctcggaagccggacacccgcctccctgagaatctcaaaggccacttccatcgtcagcgcttcaatcacggccgggaacggcaccgtctcccgctgggccgcgatgacaatcagcagctgcgtcggaatcatttcctggtgaaaggtcgtcgccgccacataaatccccggcgccaccagtgaaatgaagaaaatcaaaacccgcagcaccctgatgctggtggcgatatcaaatcgtgaataataatcctcaacggattgaaaaaattgaataaataaggccggcgcgatgagaacgaacggcgttccgtccacgataatcgcaaatcgtccttccagcagattccccgccacaacgtccggccgctccgtatgatatacggtgggaaacacagaaaacggcgcgtcttcaatgagctgttcaatgtagccggattccagaatgctgtcgatgtcaatgtgcttcagccgcttgcggacttccttaatcagctttttatcgcaaattccgttaatatacatcagcgcgacatccgtattcgtttcgtgtccgatctccattttttcaacccatacatcaggcgtttttacatacctgcggatcatggaaatattggtttgcagagattcggtgaatccctgccgcgggccgcggaaagagacctgggtgctcggctcttgaatggaccgatgctctcccccttccgtgctggcaatcagcgccttgtcagccccgtcgacaaaaatgagcgtgctgcccgccaccagcccggcataaagacttttccatttttcttcctctttcaccccgccgatcgcaagcgttttatcgtatatcaggcagaccgcttgttccggctgaacggacgggatgtcgattaaatcctccagaagggattggctgacgagctgttcgtctaccaaaccggcgatatacacaattgcggccggaagctcttcttttccgattttcagccggcggatgacgacatcggcactgttgccgaacctctcagacagcttcttcatattttgctttaagctgagggagatcggctcatcctgctctttgtccggctggctgtccgcttcttttctgccttcattgtcacggtcgttttgatcggcttttttttgtttcttctgcttaaaaaatggcggcatatcgcaaaaaacctttcctcgtttttttcatattcttcctgtacggcaaaagattatgcacggcggaaagtctgtataagttctgcgtaatcgaaaaggataaaaagggagagtgatgcgcatgaaaatattgggggtttcattttttttgctggctgcctgtctgatcatttcagtaacgatagatatgctgcaaggtttcagtttctatggagcggtccaaaacaacctgtccgcttttaaattgaccaccttctcagaatggctgatgctgtttttattcgccctctttttaatcagagaaatgatcgttttatataaatcaggtaaaaaagatgcctgacaggcgcacggctgtattgtgtcaaaaaagaacacatccctccttctttcggagttcatgtgttctttttatttttccgatgcagattgttttcagatgacgatatttccgctgtccgtatctgtcgtgtgtttcacaatgacgcctttgataatgcggttgccgatgattttagtacttgcggaggaattggtttggatggcggaagcagaagcggcggaaaggttgttgatggtattgcccgacacgagggaatttgaggctccgttcagatagatgccgatcgggctgcccgccgttcggttgatcgtgagcgtattgtctatgacttcatgcgtgcctgaattcagatacacggtaacgataagcggtgatgattcaaagcggttgctgatgacagaggttcccgaggatgttgaactgaaaatgggatagtttttgtagcttttgaagagatttcccttgatgacagccctggcgtcatttgtcacagatacggcataggactccgcggcgccctgatacgcattcggaatcagcgtatttccttcaataacggcatttccgcctgtgacccatatgccccggctgaacgatttcagcacattttgttttacggtgatattgccggccgacatgctgattccgtccgttacctgattcagagtattattcataaagacggcgttttccgacagcgtcgcccgcatccccgtgcttcgtctcgtttcggaacgtccgttttcaatgacattgccgtcaatggtcacatcttccgcctgatagacggaaatgcccgtattttcaaattgactgattttgttatgggtgacgaggacgctttttccccttacatctattccggtggaaaaaccggtaatcagattgttggaaatgacggcattgctgctgtcctgtccttgtgacacaccttgtccggcgactgcggtccttgagccgccgtctgaccgaaagaagatattccccgaaatgacggtatgtgccccatacccgtagctgattgtgttatcggaatgatttccttcaattaacacattatatccgttaaagttggtgactgagcttgcggcgtttccggaaaagaagttgttgcggaccgtaatatgaagagcttcttcataatcaatatcgccttctccgtacgattcaatatcgattccgaatttcggagccgttccgttcccttgcccggcgtcttcaatcacgcattcttctaccgtaacggtattgcagccggtgattgaaatgttgtttcgccttgactgcctgatctcacagcggcggatggtcacctgttctgaagtttcgtaatcactgtttgtttttaacccgagcgggctgacaataatgccgtctcccgtaaaatccgaaatcttcacattttcgatcagcacattgctgctgccttcaatacagattccaaacccccattcatgggtcgaacgcaaagggacattggtatacgtgtgttcatcccgttcgccgatgatccggccgccggtgatggtgacattttcccgcctgcctatatagaaagccgagtagccccaggagctgttcggcgccactttaatcgtgcattccggatctaaaacgatggtgagatggctcggcacgttaatcccggcgttccgaaacggctggctgctgtccccgccaagcgtgccgttgattttataggttcccggcggaaaaaacaccgtatgacagccttcgctgacggccttggccaagcattggttgatggcgcccgtcacatcggtttttccgtctgccgccacaccgcaatccgtaatatccaatatacgattcggcaagtgataatctcctccttcctctcttattgtcatcttattccgccatatcccgctccgcctgtacatactttaaattttattaaaaaagtttataaagatagtttagttagataatataacaaaataagtcattggaattagggaaattcgtctatattcaacgttttaatatcttttcattctggaattttttgaattcagtataaattatattgacacaagtattatataagaatatgatttttgtaatacacttttttaagaaagggttggctcaggtggcatctattgataaggactctataacagaaactgtgccgcaacgaggctttttcggtcatccccgcggcttgtttacactgtttttcaccgaattttgggagcgtttctcctactatggtatgagagccatattgctttactatttatacacggaagtcgctcatggcggtctcggctttgataaaacgaccgcagttgccatcatgtccatatacggatctctcgtatacatgtcgagcgtcatcggcggatggctggccgaccgggtattcggcacggcaaacaccgtattttacggcggaattttaattatgttcgggcacatcgctcttgccttccctggcagcacggcagcgttttttaccagcatggctctgatcattatcggaaccggcctgcttaaaccaaacgtatccagcgttgtcggagatttatatacgaaggaagacgagcgccgcgactcaggtttcagcatcttttacatggggatcaacctcggcggattgcttgcgccgctaattgtcggaacactcggacagaagtacaactaccacttaggcttcggatgcgccgcggccggtatgttcctcggactgattgttttcgctcttacgagaaagaaatacctcggcaaagcaggctccaatgtaccgaatccgatttctaaatcatcagtgatcggcacgggaatcggagtggtcatcgcagcagccgttattatcgttctgattcaaaccggctggctgacgatccagcgtgtgattgacaccgtcagtatcctcggcattgtcattccggttatttactttatcgtgatgttcacgagcaaaaaagcgacgaaaacggaaaaatcacggcttgcggcttatgttccgctgtttattgcagcggcaatgttctgggcgattcaggagcagggcgcgacgattcttgctttatatgcggatcagcgcacgagactttcctttgcaggcatgcatcttgagtcttcatggttccagtctctgaacccattattcatcgttattttcgcgccggtgttcgcctggatctggatgaagctcggcaaacgccagccttcaacaccgattaaattcgcgatcggcattatccttgccggattatcatttttagtcatggtgcttccggttatgggcggaagcggcgagcttgtgagcccgctttggcttgtgctcagcttccttttggttgtgcttggtgagctttgcctttcaccggtcggtttatccgtcacaacgaaacttgcgcctgccgctttctcagcgcagacgatgagtatgtggtttttaacaaacgcctgcggtcaagccctgaacgcaaaagtagtcggtttgtttgataagatttctgaagcggcctacttcggctcaatcggtcttgtttcgatcattctcggtattattttgattcttctgtctcccgtcattaaacgggcgatgaaaggcgttcaataacagataaagaaaagcctgcggaatcgtccgcaggcttttttgatgcgtctattgttttaactcctcaagcgtttctctccatctcttcaagacatcttccggttcgtggagctggatggccggtccggatgtcagatccgcgtatttcgcccgatcttccttgacggtgatcacccggcagctgaaccgttcccgctcgtgtttcgcctctttcagcggcggaagcgcctcacattccaatgtgacgtaatatgcggctcctccgtgccaggcgatgaaaagagcttgtcccgaatgcagcaggctgcttacggtcgtcgtgtttttccataaggcgagccggagatttgttctgctcacggccacgatttcaccggcgctgatcatggccgcgtgcggacggccttcttttgtcacggattggagcacaaatgcgtcgtgctgctttttttcaagctccgtcccgtctaaaagcgtgtaaagcgcctccggcaagtgctccgtcagcattatgcttttctttccgggacagcgggtacatgtgcggccgtctccgtttctttcggatcgattttaaatgccgggttgaatgccgccggattcgtgatgctttccggttcacaggatctccatgtgaaaaagcaggtttggcattggtaaatttcccaggcgcctttgaccggcgattggctgacggtttctccttttttcgattcacagcgcgggcatgttttcattgcaacctcatcctttcttattgattcattaagtccatcagtttttgttcccactctttcgttgtcagcggagaatcaagcggctgcgaataatggcctcttgtttccggcgcggcgggcgtcgtggcgtcaagaatcattttgtgtgtcatccctgccggatcagaccccgggtcaagcggaaggacggacaggtcaggaatgatgactgcatcgtgtttcggatgcattttcgttgagagcgcccacatgacttgcggcaggttaaacggatcgacatcctcatccacgacaatgaccattttgcagtagccgagtccgtgcggcgtggtcagggcgcgcatgccgaccgccttggcaaatccgccgtagcgcgttttcgttgaaatgatggcgatcaggccgtgcgtatacatcgcgttcacggcgacaatctcgttcggataagcttccttgagctgctggtaaagcggcacgcacgtattaatgccgatcatataatcgcactccgtccacggcatgcctaagtataaatgttcaaaaatcggattgtttctatgatatacccgtttgattttgatcaccggcatgctgcggccgccggaataatggcccgtgaactcaccgaaaggcccttcgtattcccgttctcccgcaaggatctctccttccagaacgacttcagcgccccaagggatgtctaaatcagataatttagatttgacgattctgtagggctccccttgaatcgcgccggccatttcatactcggattgatcgtataacagcggagttgacgcagctgtcgtaatcaccggctcacagcccagcgcgatcgtaacgggaagattcacgccgcgttcttcagcttggcgaagatgaatcgcaatatcatgctgaggcacgggctgaatgccgaggcggtcttttccctttacctgcattctgtaaatgccgacattctgcttgccgaaattgtccggatcttcaagatcgcgggaaatgacacacgctttatccaaatagtagccgccgtccccctggttgattctgaatagcggaaggatgtcaaatagattgatatcttccgttatttcattttcatgaaacggcgcggtttcttcccgtttgaccggcatcggaaatgcatcgtaccgtttggcaaactcaaagaattgttcctttacaggcgtatctttcggcatgccgagcatcatcgcgtgattcggccacgagccgatgacattcagagccacctgcgcatggtgatgtccgtaaatattgttaaacaaaagcgcaggggttttatccccgagattgctggctgcacgcgcggcggcacccagatccggctccggttttacctcttcgttgactgttaagagctgcccttctttttcaagagcggcgagaaattccctaaaatcctgataggccattatcagattcctcctttttgtttttcaattccgtaccaccgtttcgcttccggcagacggatgccgaactgatcgagcgtccggaacacaatatggtcgatcaattcatccatgtcagccggcttgttataaaatgccggcatcggcggaagaatgacggaacccatttttgtaagcgctagcatattttctaaatgaatttggctgagcggcgtttctcttgtcagcagcacaagttttttccgctccttcaagatgacgtcagccgcccttgtcagcagattgtcagccattccggtgcggatgcttgccagtgatttcatgctgcacggagcgatgatcatcccgtccgtttcaaacgagccgcttgaaatcgccgcggcttggtctttgtgagaatacgtataggatgcgagtttctcgacatcttttaacgtataatcggtttcatgtgtaatggtgacatttgcccaaggagacacgacaagatgggtttcgatctccgcggcttttaaatattctaaaagcctgatcccgaatatggctcccgttgccccggtcattccgatgacgagcttcatattgacccctcctttacgcttgaaatgtggtgtcaaaaccatcatactcctgatatatccatatgaaaaatattcgttaaatctatgtatcataccttaaaggtataaaagaaaggagcgcgttctcatggatatccggcaattgcgttatttcatcaccattgcccaagagcagaaaatcacgacggccgccaaaaagcttcatatggcacagccgcctttaagcagacagctgaaacagctcgaagaagaattgggcgtcattctgtttgaccgcaataaaaagaaacaaatgacccttacatatgaaggaaatgtctttttgaaaagagcgaaagagattcttcataagtttgaggatgccattatcgaggtacaagagctgaaggaggcggtggccgggacacttgccgtcgggtcaaccatttactgcgccgcgctcatgcttgagaaagtgtcacagatgaaagagcggtttccgcatcttacctttaacatttgggaagatgagcctgtctcactgctcgagcttctggaaacccggcagattgacgccgccgtcaccaccaccttgattaaaaacgacggcattgaatcgaaggagcttgaagacattccgtgtgtattggtgctgtccgagcattcaaaacgactgtgcggtgaaacgattaaactgaatgacatcgcctctttgcctttgatccttttgcgcaccgtcaatggaagaggtgtgtatgaccaagtcctccaagtttgtgaacagtacggtctcgaccttcaggttgtctgtgaatgtcatgactccgcgactctcttgagcctcgtatcatcagggttcggcgccacaattctgcctttgacgatgattcccgtccatatgcgctcgcatgtcaaaacggttatcatcgaagacaacccgtttgtcatgacaccggccgtcatctggagaaaagacagctatctgccgaagccggtcagacagtttttggaattattttgatccggaacacgaagaattcccgcttatgaaaaccaattacttgactcatactaaaaaaaagttatcctttacaattgggagctattttttctcaataaaactactcagaaaagtggggaataaagaagatgaaaaaagcattattcgctttgttcatgatggtcagcatcgcaatgcttgcagcctgcggaaactcacaggacagcggatctaagtcaaaagacggcgatctttgggcttctgtcaagaaaaaaggcgtactgaccgtcggcacagaaggaacgtacgaaccgtttaccttccatgataaaaagagtgacaaactgaccggatatgatgttgaagtgattcaagaagtcgcgaaacgcctcgatctgaaagctgacttcaaagaaacgcaatgggacagcatgtttgccggattaaacgcgaaacggtttgacgtcgttgccaaccaagtcggcaaaacgggccgtgagaaccaatatgatttttcggataaatacacaacgtcaaatgcagtcgtcgtgacgaaaaaagacagcacgattgcgaaagaggctgatgtcaaaggaaaaacagcggctcagtcattaacaagcaattacaataaattagcgaaagaagccggcgcgaaaattgaaggcgttgaaggcatggctcaatcccttcagctcattcagcagggccgcgctgatctgacttacaacgataagcttgccgtactgaactacttaaaaacgtccggcaataaaaacgtgaaaatcgcgtttgaagcaggccagccgcagcagacgtatttcgcattccgaaaaggaagcggcgaacttgtgactcacgtcaacaaggcgttaaaagaaatgaaagaggacgggactctttctaaaatagcgaaaaaatggttcggcgaagatgtttctaagtaacatgccggaacccgtgattgcaacagccattccttgggatctggtgcagcagtcattctggccgattctttccgggggaatctattactcgattccccttaccattctttcctttatttttggaatgatcatcgcgctgattacggcgctcgccagaatgtcaaatatgaaaccattgagatgggtgttcagcgtatacgtatcagcggtgcgcggcactcctcttctcgttcaattgttcatcattttttatctgttcccgacatttaatattacgctggaccctttcccaagcgcagtcatcgcgttttcattaaacgtgggcgcctacgcttctgaaatcatccgggcatctatttcatccgtgccgaaagggcaatgggaagccggttatacgatcggcatgacctatcgcaagacattgttccgcgtgatcctgccgcaggcgtttcgcgtgtccattccgccattatcaaatacatttatcagcctgatcaaggatacatctctcgcgtcacagattctcgtcgcggagctgttcagaaaagcgcaggaaatcggcgcgcaaaaccttgatcaaatcttggtcatctatattgaagccgcctttatttattggatcatctgcttcttgctgtcaatcgtacagcacgtgatcgaacggcgtctcgaccgttatgtggccaaataaggaggtttcgatatgctttccgtcaaaggattaaataaatcattcggacagaatgaaattttaaaaaagatagatatggagatagaaaaagggaaagtcatcgccgttctggggccgtccggttcaggaaaaacgacgcttctgcgctgtctgaacgcgcttgagatccccaatcgcggcgagctggcattctccgatttttcaatagatttctccaaaaaagtgaagcaggctgatattcttcgcctccgccgcaaatcaggcatggtctttcaggcgtatcatctgtttcctcaccgcacggcgcttgaaaacgtcatggaaggacccgttcaagtgcaaaagcgcgacaaggagcaagtcagaaaagaagcgatggagcttctggaaaaagtcggactgaaagacaaaatggatttatatccgttccagctttccggcggtcagcagcagcgtgtcggcatcgcccgcgcgcttgcgattcagcccgagctgatgctgtttgacgaaccgacgtcagcgcttgatccggagctggtcggcgaggtgcttaaagtgattaaggatctggcgaacgaaggctggacgatggtcgtcgtcacccatgaaatcaaattcgcgcaggaagtggccgatgaagtcatcttcattgacggcggcgtcattgtggaacaaggaccgccggagcaaattttctccgcgccgaaagaagaacgcacgcagcggtttttaaatcgtatactgaatcctttgtaggagcgggagaagaagcgaaacactgatttcgcttcttcttttttttggcggttatgctacaatgacaattaatgaaattttatgaaagaagggacctctttgaagcgggaattcttgatgcgctggacgttttattttgccggtctgttaattttgtctttcggggtatcgttaaccattaaaggaaaagctctcggcatcagcccttgggatgcctttcattatgggctttttcagcatttcgggctttctgtcggccaatggtccatcgtggtcggcgcggtcatcgtggctttaacctgcctgttcacaaggacactcccgaaaatcggcgctatcttaaacatggtgctgatgggaatgtttattgatttcttttcgtttctgcttcctgagacgcacgctttttccttagcggccgtgtttttttctatcggattgctgctgatcggctgcggcgtcggtatttacgtatcagcagggctcggcgcgggcccccgggactctctgatgatgctgatatctgaaaaaacgggctggaacgtgcaatgggtgcggaacggcattgagctgacgattcttgccgcagcctggatgatgggcggaccgatcggcgccggaaccattattacggctgttttgacggggctgattctgcgtttttctttgccgcagtcctctaaactgttaacatacgcgatctccgggcgggcaacgtccgttcattaaaaacaaagccgaaacggttttgtttttttattttcggacagctttcgtctgatatgataggatggttttgacaatattttcagacggaggatcggacatgaagatttacggagtatatatggaccgcccgctttctgcaggggaagaggatcggatgatggcggccgtgtccgccgaaaagcgggaaaaatgccggcgcttttaccataaggaggatgctcaccgcaccttgatcggcgacatgctgatccgcaccgctgcggcgaaggcttacggacttgatccggcagggatttcattcagcgttcaggaatacggaaagccgtacatccccgcgcttccggacatgcactttaatatttcccactccggtcgctggatcgtgtgcgccgttgattcaaaaccgatcggcattgatattgaaaaaatgaagcccggcacgattgatatcgccaaacggtttttttcgcccacggaatacagtgatctgcaagcgaaacaccccgatcagcagaccgattatttttaccatctgtggtcgatgaaagaaagctttatcaaacaggccggaaaagggctttccctgccgcttgattcattcagcgtccgcctcaaagacgacggccatgtgtccattgaacttccggacggacatgaaccttgtttcatccgcacatatgaggcggacgaggagtataagctggccgtttgtgcggcgcatcccgatttttgtgacgggattgagatgaaaacgtatgaagagctgttataagcaatccgtcagcattttgatgcctcgcgtgatatcccctgtcttgacgttggacacgttgagtttgatgatattttctttcggaaaatccgataggtaatggctctcaatcggctccaccagcacgccttgcgctttcagacgctgcacaactcttgaagcggaaaggcttttctccagcacgagatgggtatggatcgacgtttgctttacagaaaaaccgccgtactcctgcagcgcgttttggagcagctcggaacgtgctctgtaagaggcccggattttttctttatgccttttgaacatgccgcttttgatatacacttcaagggccgcttgggatatcatcgaacagtcgatatcgctcagctttttatacgtatggaaaaccggggccagcgaatccgggagcacagccgctccaacacgcagccccggaaaaatcattttcgaaaagcttttcaaataaatcacgcgggaagacagatcgtaggcgtacagcgggtctgccttctgattgtcctctaaatctcctaggaaatcatcctcaaccaaataaacgtcatacgcctccgctaatcggacaagctctcgtttttgccattctgtcagagagctgccgagcggattatgaaatcggggcatcgtgtaaaaaaacttaatttcctccgtctgaaacagccgctcgacttccgccatatcaagcccctcagccgtccgtttaatgccgcaggcgggaaggcgcagcgcttcaagctgctccaccatcagatgatagcccggctgttcgattaaaatcttcttttttccgttcggaaacggcatcagagacagcagggataacgcctgctgcacacccgaggtgataaaaatgttccgctcttttgcaaatacctgataatcggataacagcgtctgaagcacccggattaaagacggaagcccctgcggcgtgccgtaaatgaacaaatcatttttatacatatcaatggctttgttgatgcaatgctgaaagtcgcggtacggaaaaatatcagggtccggcgccgaggctgcaaaatcaatgatacctgtttgttctcgctcctgctttttttcatttttaataagatagtagccgcttttcggcacggcataaataatgtgccgtttttcaagctcctgaagcgcacggatgacggtgcttttactgacgtgaaaacgctcggccagctgcctgatagaaggcagccgcgccccttcctgaaaagtgccgccttcaatgagactctccacttctatcatcacgttcatatacttttccatgctgaacctccatctgtaccggtacagtttatcattattctcattgtactgcttcttcccttcccatacaataaaagggagcggccggcgctcgatctcattaaaggagttcgtaaagatgattaatcaaaaccgtttggctgctgcttacctcgctgccattttaaatgcgctgattatcggtttttcctttatatttgtcaagattgcgcttcaatccgccaatccgtttgatatattggctcatcggttcacagcggccttcatctgtgcaatgcttcctgttttattcggctggatcaaactgtccgtcagctggaagaatgtgctggcgatcttgcctttggcccttttatatccggctttgtttttcagttttcaggcgttcggccttttgtattcttcatcatcggaagccggtatcattcaagccgccatcccgatttttacgatgctgttttcgtcttactttttaaaggaacgtccgacatgggcgcaaaagggattcacatgcctgtcagtggccggggtggtatttattttcacaatgaaaggggtgtccgcggaatcggcgagttttaaaggtgcttgcctgatcctgttgtccgcgctgtcctccgccctttacaatacggcagcgagacgcatgacccagcgtttttcattgggtgagctgacctggtgcatgtctgcgatcggctttgcttccttcaactgcatcgctctcttccggcacggagcggaaggaacgatcgggcagtattttctgcccttccgcgatcccggttttatcgcagcgattctgtatttaggcattttgtcttctctcattacatcattgatgtcaaactacgcgctgtccaagattgaagcgtttaagatgagcgcctttaacaatttttccgtcctcgtgacgatgcttgcgggtgtcctcgttctccatgagtcactccgctggtatcatatcgccggcgccgtctgtatcgtcatcggagtcttgggaagcaatgcttcaggacggcggaaaaaaaacatattacgacatagggaaaaaatgaaaggaaacgaagacggaatatgatcaacacacgaaatgaaaatatctatctcgcgggctgcttaacatttgccgatgtaagaaaacactttgcttatcatcaaggaaaatccgcggctgtctgttttttgattatgctgctggcttctgccatctgttttgaaatgaacggcccggttacaggcggcacatggggcgtcagagctctcctgaatttccttgcagctgtgattctctctttggcagtcacggtgatcgcaacggcaatctcattcttccgtctttatagaacatacaaaacgaatcagcggctgaaatctgccagaagtattacgattcatcagctcggaatcagccaaaaacaaaaaaacgcaagcattctttttgaatgggatgaactgctctcggctagggagcacaaagatatgtttcgattacaaacatcgggttacggaacacttctgctgccgaaacgacttttctattcgcaaaaagatatcgccgttttcaggcaaatgctccgggaaaatgtgaatgggaaagtaaatgtaacagaataaaagacaaaaaggagggtgtccccctccttttttgtcagcctgatatttccgcctgtttctgcagctgctttgcttcctgataaatttcttcgaacagatccgcgatgtgttcttcttcaacacatgaaaatgcgattcgcaaatcggtttcattaatggatatcgtcccgattcctctcttttcaagcaacgacactctcaattcgccggcgtttatgtctttcagccggacacacatgaaataaccagagttaaacgggtaaggcgtccatacgtcatcatagtgcttgttttctgcaagaacggctttcactttgtcagcccgttttttcatgatgttatatttcagcgatttttctttctcgtattccggtgactgcatcgcccgcagcataaacgtttgggacgggtgcggggcgcttgaaatcgttcccctgataatcccttttgttttttcctcgagcacgcgcagcgctttttcgctttttgtgctgtacgtaataaaaccgacgcggaagccccacgcgtaattttccttcgtcgcgccgtctattttcacgcaaagcacccggtcgtgcacttgggcgagtttgctgaagatggattcctgaatggccgtttcatcgtaaaacagattgtaatacgcatcgtctacgagcacgacaatctctttgccggcttctgccgcctccaggatcacgctgacgatttctgacgcttcctcttctcccggcgtgtagcctgtcggattattcgggaaattcagcacgacaatcgccttttcttcctgctttttcagcagctcggacagccccgccgcattaaaacgcccatcctgctgaaaaagcgggtaggtctcaatggatgccttgcgccggacaccgaaaatgaaattgtaatttccccaatatttatcaggcagaagcagcgtatccccttcattgacgaacaagtcggcggcaatgctcagcccgtgtgttaaagcgtttgtcacgatcggcgtgctgatgtctttgccggctaatgaaggattttcgagacgcatttttttcagccattcctgtctgagcggctcttttccctgcggcggagcataatcgtagatatcatcggggttataggcggacagtgtctcttgaatatgggaaaagtgcatggactcgccctgtgaggtggcaatcccgatcgtggcattatactttccggccttggctttcgcttccgccgattgtgtcagcacccctttcggataaaacaactctctgcccaaatcagaaagcatatgaagcacgtgcgggttttcttcagataatgttctgttcagctcttttgctgcatcattcatgtacgacaatcccttcaaaattatattccatcaaatcataacataaaatttttgataaatgagaaaactcgcgggcggattttgttacaaaaaacagacagcgaatgctgtctgtcatatcctataacaattggcctgcagtgctcctgttaataatctcatagattcgttccgccactttttcagtttcacttaatatgaacatgtggccgtccgaaaactcatgaaatacgggattgtcggcccattttttccatccgtccgcatctttgatacattttttatctttccgcccgttaaatatatggacgggtgattgaatgatgtgagaatcagacggacggaagctttcaagcgcgcggtagtcggatctgaaagaaggcaggaaaaatgacatgacttccttattctccactaactcctgcggcattccgccaagctcgataatatgggcgagaaatttttcatcatcaagatgagacacttttttcctttcaacatgcggcggctgaatggctgagatgatcacggcctgcgggtaaatgccctcccgctccagcttttgcgccagcctgaaagcgaccatgcctcccatactgtggccgaacagcacaaacgggcggtcgggatggagattcaactcctgcttgtataaactgacaagctgttcaaaatcctcaacggcggacatttgatttgttccgtgtcccggcggttccgcggcaagcatctcacactcaccttgaagataggtgtggagcgggcggaatgatgcggaatagcctcctgcgaacggaaaacagataagctgcgttttttccgtggtatcgaacgatttaaagagctggaccattggcgggcttcctccttttctatcgtgaagttgtcagcttcagatgttccttccttaggaattcgagcaaatatgccgcattcctttcgagacattctccctgaagcatttctgcgtgagtaccgcagccttttttcacacggtattcacctgtcgtggcttcctcccacgaagcgagccacggcggcatcgcaaagtccggttctgacgttaatagatctatatccgctttgaccctgccggtgctgacggtatgcacaaaataagaataaaacgcgtttgtttttttggcgagaccttctttgacggcttcgttattcagcgcttcattgtcccggtttaccttcatcagcgcctggacatcactttctacggtgcggccttccaagtcgctgacgccttgttttttataggaatcaaccatgatcagccgctccactttacggccttcggcttcaagccgtttggccgtttcaaaggcgagcgtgcagcctgccgagtatccgaacagcttgaccggtccttccggctggagctgattgatcagctctgtgtagcgttcgatgcggttgtcttcctcgataaaatcaaacgcacagattttatagccggacagctgttttgccagcggctggtacatcagcccgtaaccgagaaccggcgggaacgcaaacagtgtgtcagactgatttttattcatgatggtgagatctttcattcctttttcttcaccgtgaagcagataaccggcaatgtctgcgattgtcgtcgcttcgaataacagctgcaccggaatgtccgtaccgagctcttttttaatgcgcgacgctgccgtcatcgcttttaaggaatggcccccgagcgcgaagaaatcatcatgaatcccgatctgctgtctgccgagaatctcggaccagatgtgtgcaatcgtttcttccgtcgcgtttcgaggcccgatccattctttcgccgcctgagcctgatccggtttcggcagctgccgtttattgaccttcccgtttgtcgttaacggaagctcctctaagaaagtaaaggtttgcggcaccatgtaagcaggaagctgttttttcaggtgcctctttacgtcttcagctgaaagcggcgtccggttcacgaggtaggcgttgattgatgcatctccagactcatggcggtccgcaacaacgaccgcatctttcacacccgggtattcctgcagctgcttttcgatttcttcaagctcaatccggtgtccgcgtattttgacctggtcgtcaatacgcccggcgtattcaattgttccatccggcagccagcgtgctaaatcccctgtgcggtaaagcgtttctcccggcttgaacggatttgggataaacgtttgcttcgtcaggtcatgacggttcagatatccttttgatacacccattccgctgatgcacagttcaccgacagctccgaacggctgaagctgattttgcccgttaagaatataaacactggcattgctgatcggctttccgatcggcaatgaggaaatggaatccggtatgtcgtgcacgacgtgagctgtcgcaaacaccgttccctcagtcggcccgtagcaattaatcagcttgccaggccccatgatctcaagcgcctttctgacgtgaggcactgacgcgcgctcacccccgaataacacacagcgaagccccttcagccactcctctcccgcatcggtgagaagattaaaaagtgcggttgtcgcaaacatgacattgacattctcctgccggatcagatcagtgagccgttctgtatcaagcagtgtatgttcatctgcgataatgagccgtgccgcattcagtattgatgcgtagaaatcaaaggtaaatgcgtcaaaggcgtaattggaaacagataagaacgtatcttgttcagaaaatgccatgtagtctacatgcttgaccaatccttgaatattggcatgagtggtgatattgccctttggctttccggttgtgccggacgtatacataatatacgccggatcatcgggatcaattgcggctgcaggatcgcttgcctgttcctcaaaccgtgctcgatcatcgatgatgagtgttgttcctgtatacggcagctgagccgctttttctttcatctcctgatgtgtcagcagacaggctgccgcactgtcagccagcatgtacgagattcggtcctccggcagcttcggatcaacgggcagataagccgctcctgcttttaatacgccgagaatgccgatcaccagctcaagcgagcgcttcgtgtacaacgcgacaacggtgtccttacccgcaccttgcttttgcaaacggcgcgcaagacggttcgcttcctcatctaattcgcggtaggaaagagtctggccggaatacgtaagcgccggtgcatctggatttacattcaccgcttccttgaaccaatctgtcagaggcttcgcctgatgagtctgagccggcgggtttaagccggtaagcagaagctctctttccttttcatcaacaagtctgatcgtattgacaggctgatccggcttctggatgagctgctgaatcgctgtgagaagctgagattttaagcgcaggataaacgcctcatcaaacacattcccgttataggcaagcttaatcagcatctcatcacctggagaagccatcaggttgagatcataattcgatttctcaaatacatggacgtcctccatatcaaagccgttttcactgttttcttcattttttgcatcctgaagcggataattttcaaacacaatgatgtggtcaatcagctttggctgatcggcctggctttggatatcatagagcggcacatattgatgcggctcagactgcagcgattgctcctgcagctgcttgagcaagccgttaaatgtggtatcctcagacagtttcacccgcctcgggacagcattgataaacagcccgaccatatgttcaacgcctttgatttctgcgggacgcccggaaacgactgtgccgaagatcaaatcgccggactgctggtagcggctgattaatacactccaaaccgcctgaagcgccgtactcaaagtggtatgctgcgattttgcaagctcggtaaatgcttttgtttccgcctccggcagtgagaagagcagctctttcggctcatagccgtccttttgtttctttctttgctccgcaaatgtcgtttgtccttcaaaatcttctaagtacccgcgccagtaatgcagtgatgcttgtttatcctgcttttcaagccacttgatatagtctttatacggtttgaccggcggcaggctgtacggcttttgttcacgcagggcattgtataccttaaacaggtcctgcacgacgatgccgaagcaccagccgtccaaaatgatgtggtggtagctccacacccattcaaagctttcttccgattttttaaaaatggctgcccgcatcggaatatcccgcgtcaaatcaaagcccttgatcttatcctgttctttgtattcattgattttggctgtttgctcgctgtccgttacatgtgtcagatcgatttcttctatctgaaactgacgttttttcaatacgacttggaccggcctttttactttttcgtgaatgaacacggtacgaaatacatcgtaccggtccatgatcacattcatgctttcttcaaggcatttgatattcaagctgccttttactttcattgtcatttgttcgatgtaaaaactttggccgggattcaggagagtatgaaacagcattccctcctgcatcggcgacaaataatacatgtcctgaacctgatctttgctgaattggctcatctgctccgctccccccttctgttatctgtttttgtcacgttaaattctcctcaagcatgtcaaagatgtctcccatttcatccatctcaagatcctgcgcgctgaaatcgctcggcgtaaattctttctcctctttggccgtgcaatggcggatgatcattaagagattgtctttaaaccgctgcatctgtgtttcgacggtgcttctttcatattcttcctgattgtatgagcaggaaatgacgaagcggccgcctgtaaccatcccgctgaagcttagtgcgtataacgcctctgactcttcgctgacttgacgtcccatatcatatggagacggctcaaaccattccgttttcacttcattgtcaaactgccccaagtagttaaaactgatttcaggcgtgacgcctttttctgtttcatcggatgacagataccggagaatcccgtaaccgacgcctttatcaggaacgcgccgcaccgtctcttttaccgttttaatgacggaagagacgccgtcttccttgctgatctgcagaatcaacggatattgggccgtaaaccagccgaccgtccgtgaaatattgacattcggtatgatttcttcccggccgtgtccttctaagttgatgccgactttgccgttttccgtccattcaccgatcgttaagccgagcgcgctgagcagaatgtcgttgatttccgttccgtacggatgatgaacatctgtgagcagctgtgccgtttcttcctcagtcaattcacatttcacggccgccgtatgtttgacgagccgtttgttcggatcatggtctttcggcagcggccggagttcttccgtatctgcctgcgcccaataagccgcctgctttttcagctcttctgattgcgcaaatgtgttcagcgcctccgcccaatctttaaaggagtgggttttctgcgggaggacgatgctgttttgctgctgcgcctgtttataacctgaagcgaaatcctcaagcagaattctccatgaaaccccgtccacgacgagatggtgaaccgcgattaacagatgatcgccttgttctgtccggtattgctccgcttttaacagcgggccgttctccagatcaagacttccctgaagatgatcggcaagccgctgaatctggcttttcagcatatcctcgtcagttccgtacagatcaacgatttcaaagcttgccttgcattctgtgacagggaggtatgtctgaatgatgccttccctttcttcacggtaaaccatgcggagcgcatcatggtgttcaatcaatgcttgcagggttttttccaccaggtccggatcaaagccgtctttcgcgtgaagcatgacggattggttccagtggtgtttgtccgtgaagtttttctcaaagaaccagcgctggatcggcgttaaggccgcttcgccttcgacagggccctggtcggcctgcttgccttccgtccgctccacataagagacgagctcttcgatggtcggatgctggaagagatccttcatctccagcttgtagccgtgctggttcaggcggctcgccatttggatgcctttgatcgagtccccgccgagggtgaagaaattatcgcttacgccgatctggtcaagaccgagcacttcctgccaaatgtcggaaagcagcgtctccatctccgtttccggcgctttgtatgccgcgcttcccgcttcaatatccggttccggcaggacttttttgtcaatctttccgtttgcggtgaccggaagctcgtccatctccacccagaacgccggcaccatgtagtcaggcagcgtgtctttcagcgcggatttgagcgcttcaatatcgtcctgctgaggcgcgacataggcgcaaagcgcggtattgcccgctttgtcttccacggccgtcaccgctgcgtcatgaacgtccgcaagctgggcgaggcggacttcgatttctgaaagctcgatccggtagccccgcactttgacctgctggtcgatacggccgatgtattcgatgccgcactgcgcgttccatttgacgaggtcgccggtccggtacatgcgctcgccgggcacgaacggatctgcggtaaaccgcttcgccgtttcttcttcacggttcaggtatccgcgcgcaagaccgcggccggccacacacaattcaccggcaatgccttccggctgcacctgatcgccgtcgccgagaatataaactctcgtattggcaatcgcccgtccgatcgaaagcgatccttcctccggattgatgacgccgcttgtcgcgacgacggtgttttccgtcgggccgtagttgttgatgatcgtgtacggctgtttcaccgcccgcttcagcttgtcgccgccgacgagaagcatgcggagagaggtattttccagctccataaattgttcggccagctgcgtcggcaggaaggtgatggtcacgccgtgctcttcgaaatagtgatttaagcgggtgatatccagccggatcgcttcgtcaatgacgtgaagctccgcgccgatagtccatgtcgggaacatctcccagatggaggcgtcaaaaccgaagcccgcgtatttggcgcttttatcatccgccgtcatggcgaatgcgtcgtgatgccagaaacacaggttcaccagcgcatggtgttcgaccatgacacccttcggctgtccggtcgttcctgacgtgtaaatcatataagcgagatgatccgccgttgtttccgtctgcgggttcgcttcatcgttttcatcaagcggcaggctcagaatggagcgtccgccgtcaagcagaatcgtttctcctttgtagctttccggcacgcccagcgcttcctgtgtgagaagaagcttggcgccgctgtcctgcaaaatgtagctgatccgctcttccgggtagtcggggtcaatcggcacaaatgccgcgcccgctttcaggacgccgagtacgcccgcggccatttccaaggacggtttcgtcaaaatgccgacacgttcgtcagccgtgacgccgcagtccatgagaatgcgcgcgatgcggttagcccttgcgttcagctcgccgtacgtccatttcgcgccattgtatgccgcggccggtcggttcgcgtagcgggcggccgtatcttcaaagagacggtgaaccgttttgtcccgcggcacagaaagtgtttttcctttccatgcgtcaaggagggcttgtttttcagcatcgctgatcagtgaaatctcaggcagctttctgtccggactttctgccgcttgcttcagaatccgcaggaacccggcgctccacttttcaattgtttcttttttaaacagatcagtcgcatattcaaactgaaggccgagaccttcttgatccgtaaagccgccgagtgtcagatcgaatttcgccgtgccttggtttgactcatacggagtgatgcgcaggttctccagttccagtgtttctttatccggatcttctgtcgtcaccataacctggaacaatgggttgcggctcatatctctcggcaggtcaagctttccgatcagatcttcaaacggataatcctgatgcgccagcgcgtcaagattggtttgtttcacccgttcgagcagcccggcgaaggtctgctcttttcgcgtttcattgcgaagcgcaagcgtattgacaaacatccccggcatttcctgaacttcggcgctcgttcttccggcggtcaccgagccgataatgatatcgtgctgccccgtgattttgctcaaaaagacatggaacgcggcgtgaagcaccatatgaagagtcgctcccgatgattccattaattcacgcaccgctttttccgtttcacgccccgctctgaaacggacggattgtcctttaaaactttgaaccggcggacgggggaaatcggtcggcagattcaattcaggaagctcgccggaaaatgcggagagccaataacgctcatggtctttcatccgttcggcctgctcgggttcattctgccagacggcgaagtctttatagtgcaggttcggcgacggcaggcttccgcctttgtaaagatgagcgagctctttgaccagcatacttctggacacgccgtcggcaataatatgatgcatatccagcagcagcaggtgtttcttttcattcagtctgacaagagcggcccgaatgagcggagccgcactcagatcgaacggcttaatgaatgcctgaatgataagatccgctttctcctcgtccgctgcttcaaagatgtgcaggtcgatgtcagcctgttctgcgatctgctgcatcgggcggccgttttgatcgataaaggacgtccgcaaagactcgtggcgattgatcatctgattgagcgcttcctgaagccttgaaatattgacttctccttccatcagaagaacggacggcatattataactgattgtctcccggtcaagctggttcaggacgtacatccgtttttgggcggatgataacgggtacgcgtctgcactgtcggcaggtgagatcatccgatatccctcagataccgctgatttttcgatatatgcggcaagcaggcggacagtcggctgttcgaacagcgcttttaacggaaccgttttgtccagttcagcctgaatattggcgaggagcatcatgccttttaaagagtgcccgccgtaatcgaagaaattatcgtcgatgccgagcgtatccgtaccgagtgtctgtttccaaatgcggcacagcttttcctccaattccgtttccggcaaggctgaagctgtttgcgccgtttggctgacgcccggtttcggaagggcgtttttatcggtttttccgttggctgtgagcggaatgcggtctacttgtatgaaataagccggaagcatatgagacggcagtgtttcggaaagccgtttgcgaagctcagagcctttcagctcgctgtcggctttataatacgcgcacagttccggcagcccgccttcgctgactgcgagaacgaccgcctcctgaatgccgtttacgcttaacagcacggtttcaacctcttttaattcaatgcggtagccccggattttcacctgatcatccgcacggccgataaattcaatcgtcccgtcaggaagcctgcggacgacatctcccgttttgtacatgaggctgtccgacgaaaaaggatttgagagaaatttctccgccgtcagctgcggacggtgaagatatcctctggcaagccccttcccggtaatataaagctcgccgcttgcgcccggaggaacgagctgcattgctccgtccaatacaagcgcgccggtatttgcgatcgggcggccgatgacgggacgctgctcatattgatcaagacgctccatattgatccgttccgcaatggcgccgatcgtcgtttccgtcggcccgtagtgattgatgaagtcggtatgggcgtatacgtcatgaaacttgcggacatcggacgtgatgatcttttctccgccgagcaccactaaacgaagcgggctgaaacggcgttctgacgtaaaacgggctgtattgacgatcatatggaacaatgacggcgtcagtttcatatacgtaatgccgtttttctgtatatactcaccaagctgatcaggcgcggtgtacgtctctttcggcacaatgtgcagctcgccgcctgcctgaagaatcggaaatatggccgtatagccgagatcaaatgcgtaagaagacagcagcacggatttgtcagcttcggtcaaaccggcttcacggctgaaccatgtaacataattgattagattgcggtgctccagctggacgcctttcggtttgcccgttgttcccgaagtataaataatataggcaagctggtcggcgccgggctccgtttcaagccggtcggcgctttcgttctgccattctccgtcttccattacgaccgtttttcctttataaacggcggccgcggtcatgtttctctcattgacgaccagaagcttcgttccgctgtcttcgagagagtagcggattctctcttcaggagtctccggatcaatcgggagaaatgccgctccggctttcatgacgccgagaatcgcggtaatcaagtcggccgaacgatccatcataatggccacgatgtcctcactgcccgttccgcaagcctgaaggtggcgggcaaaccggttcgagcgttcatcaagctcacgatatgtcagacttattccgcccgcaaccgccgtgagatcaggcgttttttgcgcttgccgttcaaacagcgaaacaaaagtgccctcaggcagatccgcttccgtacgtttttcatcagaaaggagcgcttcccgttcaggagcggacagcaggcttgcgtcggccagctgaatatccggattttcagcgcaggctttaatcagattgacaaaatgagcgctccagcggcggatggtttcgtccgcaaataaggctttcgcgtaatcaaagctcaatccgacctcttctccgcgttcagccgcttctaaggaaagatcaaatttagctacatgatgatgcatggagtatgaagaaatctccaaatctccgagccgcagggccgggatctccatgttctgcatattaaataacacgctgaacagcggactccggcttgtgtccctcgttaacggcagtttttcaattaattcttcaagcggatagctttgatgctcaaaagcttgaaggctcgccgttttcacctcatccagaaattgtttgaacgtttttttgccggcaggatgcgaccgaagcgcaactgtgttgacaaacatgcccggcacgtcttggagatcaggatgctgtcttccggccgtcggagacccgactatgatgtcttcctgccccgaatatttggacagcagcacttgaaaagcggctaacaagaacatgtacatcgtcgtatccgtatcagccagcagcttcttaatctgcgccgtcacctgtttatcaagcccgaagatgacgcgttccccttcaaaactgcgctcggcaggacgcgggaaatcaagcggcagatccaacaccggcagatcgcctttgaacgtatcaagccagtaggcttcgtgctgatcgagacttgctttttcacgctgccagactgaaaaatccttataatgaatctttggcagcgcaagctccgtgccttgataaagcttcgcaagatcaccgatgaaaatgcccattgagcttccgtccgtaataatgtggtgcatgtcaatcagcagaagatgccggtcttcttcaagccggatcagcttcgaacggacaagcggcgcgcggttgagcgcaaacggcctgataaaggcttttgtcagctcttctgcatcttcttcccggccctcggcggtttcaagctcaaacgacacatttttgtgaatggtctgcacgacttctccctctgccatgtcaaacgacgtacgcagtgtctcatgacggttgattaatgcctgcatggcctcctcaagacgctttttgtctactgacccttccagcagaagtacagcagggacgttgtagctcgtgctggcctgtccgagctgattaaggatatacatcctgcgttgtgctgaggaaacaggataatgcttctgataaggcgcttgtcggatcggttcaaactgctgctcctcctcgctctcatgctgcaaataatgcgcaagctcctgaatggtcggcttttcaaataacactttaatcggcacttctttttgaaagtgctcctggattttagcggtcatcatcatggcttttaaagaatgtccgccaatcgtgaagaaattgtcagtcacacccgctttcacaccgagaatgccttcccaaatgtccgcgagtttctgctccgcttccgttttcggcgctacgtattctttttgaacggcttcagcctgaggctcaggcagcgcttttttatcaatttttccgttcgccgtcagcggaaactgattcatctggatgaagtgcgcgggaatcatatattccggaagtgattccgaaagcgttttgcgcaggtcttccggcgaaagggcttggtctgccgtaaagtaagcgcagatttcattttcatccgctttatttttccggatcacagccgcagattccgtcacattctccgcctggctgattttcgcctcgatttcgccgagctcgattctgaaaccgcggacctttacttggttgtcaattctgccgagaaactcgatcgtgccgtccggaagccacttcgccaagtcccccgtccggtatatcatttcatccggtctgaacggatcgcggacaaactgcttctccgttaattcagacaggttcacatagcctcttgccactccgcttccgccgacgcacagctcaccgggcgcgccgatcggctggaggttgcggttttcatccataatgtacgcagtggaatttccgatcggcttcccgatcgggaccgaaccgtcataatcctgatcaatgagaaaactcgtcgaaaacgtcgtattctccgtcggcccgtatccgttccaaagcgacagctccggtgatgcctttctcactttgctgacgatatgcggcacaagcgcatcaccgccgatgatgaggtgccggagcgtgttaaacatgccggcatccttttgggcaagctgattaaacagcggagacgtcaaccacatggtcgtgatccgctgctctttcagaaattgggcgaattgtccggcgtcaagcagcgtctcttttttcaccgggtgcaatgacgctccgttcagcaatgcgccgaagacttcgaaggttccggcatcaaagctgacggctcccgtttgcgccatccggtcttcttcatgaaccggcacgtaattcgaatgtttgacgagcctgatgatatttctgtgttcaatcatgacgcctttcggtttgccggtagatccggatgtatacatgatatacgccaagtcgttgccgccggccggaagattcaagtctgttccgcttaccgtttcatccgcgctttcatccagcatgacgaccgggacttgcaatgcgcccgcttgttcttgatagccctgaactgtcagcacgagccgaatcgagctgtcttccgccataaagcggagacggtcctccggaaaagccggatcaatcggcacatatgcgccgcctgcttttaggacggcaagcattccgacaacggtttccgcagaccggtcgttcataatagcggcggtccggcctttttccagcccgctcttcacaaggtgtctcgccagacggttggccgcttcgttcacttcacggtaggtccattcgcgtcccgcttcttttatcgcgatgcttgcaggcgtccggtttgcctgtgtttcaaacaaacggtgaacggcctcctcttccggaagcgccgttttcgtatcattgaatatctcaacaatctgccgctcttcttcgcctgaaacaagaccgagttcccgcacgggcgcgtcaggcgttccgaccgcggctttcatcatgcgggtcagatggtgcgccgttcgttcgatggcatcatgagcgaaagccgctccgttgtatttgattttgacagtccacctttttcccggatacacgatgagattgaaatcaaagctcgtctgctcaaaagcatgttcaactttaatggaaaagccgagtctttcctccatgcccccgttttccagctctttgtccagcggatagttttcaaacgcgaccaaatgatttaagaggctgccgtccagggcggagcgcttttgaatgtcatagagcggcacataatcatagcgctcggcttccacggcgtttttctgaactgccgccatcacgtccgaaaaggctgcatctttgtcaattttgattctgacgggaattgtattgatgaacagccccgccatcgtttctatgccgttgatttctgaaggacggcctgatacgacggtgccgaacaccacatcgtctgtatagttgtatttgctgagcaccgcaccccaaacggcctgaaacaggttaggccccgtgacttgatgccggttggcggtctgctgaatctgcgcgaccagctcttcatcccagacaaaagaatattcttcattttggtagtctttcttttctgatgccagacggcccgggagcaggctcggctgttcgaaatccgccagtcggctgctccaatattgttccgcctcctcataatcccggcctccgagccatttgatatagtcagagtaaggtttgccctggcttcccccggcgggccggccggcacgaagcgcttcatagttttggaacaggcttttcatcaaaacgcccatactccagccgtccatgacgatatgatgattgctccagacgagatacagctccttctcactgagtctgaacaccgctgctttgaagagaatatctttcgccagatgaaagccctgctgctgcacgccgcgtttatagcgttcaatatattcggtttggcgcgcttcatctaattgactgatatcttcatagtgcaccttcgtcttccgctcggctaatacgacttggcgcggtttttgaagctgctggtgcacgaataccgtacgcaggatgtcatatgtccggatcagctcattgacgcttttttcaaaaagctccagctgaaaacttccgtgaatcctaagctctaattgtgtgaagtaggaggaagaatgcggatcaagcagcgcatgatacagcattccctcctgcatcggtgtgagtgcatacaccttttgaatcgattttttgctcatatgtcacctctgtcttttctgttagagaatttccattaatttatcaagttcatcaagcgtcagatcatcatcgccaagatcgctaggcgtaagctcaggtccgtcttgggccaggcagtgatctatgattttcaagaggtgccctttaaagctgtcactgaacgattgaatggttttttcatgaaattcgagagaatgataggcaaacgtcatcgtcatctgcccattttctataaatccgacaatatcaagcgcattcggcttctctgtgtcagggctcagcgattgtcctgacggcatcccggatcttgtaaataagccggaatccgacatctcattaaactggcctaagtagttaaagctgatatccggatcaatctcaaatgaaagattctctttatgctcaggcgccgttatataacgcagaatgccgtagccgactcctttgttcgggatgtgtctgatgtcttctttcatttgtttcagctgatatgaaagatcgtcggtgtgcttcatctcaaggatcatcggatacatgctcgtaaaccatccgaccgtccgggtgatattcaagccgtcaagaatgtcttcgcgcccgtggccttccaaatgaacgccgatcgtgtcttcacccgtccactctttcagcgccagtccgagcgccgtgagcaggatgtcattcatttcggtgtgataggcttcatgtacgtttgtcgtcagctgttcagtttgttcaggcgtcagagagaagctgaccgttctcgtatgtctcatgcgctgatcaccagactgcctgtctttcggaagctgagtgcatacctctttttcctcaagctctctccagtaatccgcttctttcagaaacgccttcgtatttgcgtattctttgattctctcggcaaattcggcgaatgaatgtgttttcggcggcagcgccggttcattgccttgcttcagctgcgtatacacggacgtaaagtcctccagtaaaatccgccaagatacaccatccacgactaagtgatggattgcgagaagaaggtggtctccatcttcagcccggaagagcccggctttcaagagatgtcctgtttccagtgaaatactgctttgaagacggtctgcttcccgttcgatacggtcctcatggtcttcagcaggtccgttcagctcaaagacgttcagttcaacagacacatcctcaagccctctgtaatacggtttttgttcacgataaatcatccggagcgcatcatggtgcaccgtcaggacatgtaatgttttttctgttatctccggatcaaagccgtctttcgcgtgaagcatgacggattggttccagtggtgtttgtcggtaaagtttcgttcaaagaaccagcgctggatcggcgttaactccgcttcgccttcgacagggccctggtcggcctgcttgccttccgtccgctccacatacgagacgagctcttcgatggtcggatgctggaagaggtctttcatctccagcttgtagccgtgctggttcagacggctcgccatttggatgcctttgatcgagtccccgccgagcgtgaagaaattatcgcttacgccgatctgatcaagaccgagcacttcttgccaaatgtcggaaagcagcgtctccatctccgtttccggcgctttgtatgccgcgcttcccgcttcaatgtcaggcgccggcagggcttttttgtcaatctttccgtttgcggtgaccggaagctcgtccatctccacccagaacgccggcaccatgtagtcaggcagcttgtctttcagcgcggctttgagcgtttcgatatcgtcctgctgaggagcgacataggcgcaaagcgcggtattgcccgctttgtcttccacggccgtcaccgctgcgtcatgaacgtccgcaagctgggagaggcggacttcgatttctgaaagctcgatccggtagcctcgcactttgacctgctgatcaatacgcccgatgtattcgatgccgcactgcgcgttccatttgacgaggtcgccggtccggtacatgcgctcgccgggcacgaacggatctgcggtaaaccgcttcgccgtttcttcttcacggttcaggtatccgcgcgcaagaccgcggccggccacgcacaattcaccggcaatgccttccggctgcacctgatcgccgtcgccgagaatataaactctcgtattggcaatcgcccgtccgatcgaaagcgatccttcctccggattgatgacgccgcttgtcgcgacgacggtgttttccgtcgggccgtagttgttgacgatcgtgtacggctgtttcaccgcccgcttcagcttgtcgccgccgacgagaagcaagcggagagaggtattttccagctccataaattgttcggccagctgcgtcggcaggaaggtgatggtcacgccgtgctcttcgaaatagtgatttaagcgggtgatatccagccggatcgcttcgtcaatgacatgaagctccgcgccgatggtccatgtcgggaacatctcccagatggaggcgtcaaaaccgaagcccgcgtatttggcgcttttatcatccgccgtcatggcgaatgcgtcgtgatgccagaagcacaggttcaccagcgcatggtgttcgaccatgacacccttcggctgtccggtcgttcctgacgtgtaaatcatataagcgagatgatccgccgttgtttccgtctgcgggttcgcttcatcgttttcatcaagcggcaggctcaaaatggagcggctgccgtcaagcaggatcgtttctccgttgtagctgtccggcacgcccagcgcttcctgtgtgagaagaagcttggcgccgctgtcctgcagaatgtagctgatacgctcttccgggtagtcgggatcaatcggcacaaatgccgcgcccgctttcaagacgccgagtacgcccgcggccatttccaaggacggtttcgtcaaaatgccgacacgttcgtcagccgtgacgccgcagtccatgagaatgcgcgcgatgcggttagcccttgcgttcagctcgccgtacgtccatttcgcgccattgtatgccgcggccggccggttcgcgtagcgggcggccgtatcttcaaagagacggtgaaccgttttgtcccgcggcacagaaagtgtttttcctttccatgcgtcaaggagggcttgtttttctgttttattcaccaatgaaagctcagaaagcttcgcagccggattttccgctgcggcttctaacagttgaagccagtaatgcttccatgtctctgccgtttccggtttaaacagcgcggtgttatattcaagcacaaacgttaaaccttcgtctgtgtcctcagccgtcattgtcaggtcaaacttggctgtttttctgtcaaacggatggtgcttcagctcaattccttccatgatcagatcttccgcatttgcattttgcattgagaataccgcatcaaacagcggatttctgctcgtatcacgctgcacctcaaccttttgcagaaggttttcaagcggataatcctgcgcgtcaaatgcatgtaaagcggtttgtttcacttctttaagatagtccgtgaaagttttgtccgcttccggatacgtacgaagcgcgagtgtattcacaaaaacaccgatgacgtttgctagatccgcatgtgaccgtcccgcaaccggcgagccgacaatgatgtcatgctgtccgctcagttttgagagaaaggcgctgtatgacgccagcagcaccatgtacatagtagaatccgtttgtttcgcaagactgcgaagagccgacgtctgttcctcagtcagagaaaagaccagcttgtctccttcaaaggtttgcacggccggacggctgtaatcagccggcagcgtcaataccggaagctcgccgtcaagctcccgaagccaatgctcctcctgcttgcggtactgctctgattgaataaatttctgctgccataccgcatagtctttataatgaatccgcaacggctcaagcgtttcgccaccatacaagcgggacagttcatctatcagcacgccgactgaagcgccgtccgaaatgatatggtgcatatcaaacagcagcaggtggtcatgttcagccagcttgaccagtcccgttctgacgagaggaagctgatccaggcggaacggccggataaagctctgaataatccgttcagcatcttcttcagaggcttcataatattccatgttgatatcagcttccgtccatatgcgctgaaccgtttctccatcctgtatgtcaaatgtcgttctgaaggcttcatggcgttctgtcagctgtttcatgacggatttcagcttttctgcatcaagctttccttttaagcggagcacagacggcatgttatagcttgtttcagcgccttccagctgctgaagcacgaacatccgcttctgcggtgaagaaaccggatacgtttcccgctcggccgccggtgcgatgctctcagccgccttccgctcagccccttcaatcagctgcgccagccccgcggccgtcggagaagtgaacagatcctttaaggtaagctgcgcgccgaatgtcttctggataagggccagcagtttcatccccgctaacgagtggcccccgatctcaaagaactggtcatggacgccgacccgctccatttgcagcacctcagcccaaatatccgccagtttttgttctgtttcattgcgcggcgccgtatatgacacggcattcgctgcggtcacatccggcattggcagcgcccgcctgtcgatttttccgttccctgtaagaggcagttcatccaattgaataaagacggacggaatcatataagccggaagatccttcgccgaatgctccctcagctcccgggaagagatttccctgaggccgacaacatacgcgcaaagaagtttgtcacccgcgccctgatccacagcgagcacaatgcattcctgaatctggtcatgactttgaagctgatgctcaatttcgccaagctcaatccgctgaccgcggattttcacctgatggtcgatacgtccgataaactcgatatcgccattcggaagccatctggccaagtcgcccgttttatacatccgttcaccttccttaaacggatgctttacaaatttttcttccgtcagttcaggacggttgtagtagccttctacgagtccttccccgctgacgcacagctctcccgcgatacccgccggctgaatgcgtccggctgagttcatgatgaagacttccgtattgctgaccggtttcccgatcggaacggagagcgtatcctcttcaatgacatccaccggatggtatgtcgcaaacaccgtgctttctgacggaccgtacatatgaagcagtcttccttttccgactgccgcaagcgcctttttgacatgttctacagacgctctttcgcccccgaacatgattttccgaagcgtcgtcagacaggacggctccatatcaacaagcaggtggaacagggccgtcgtaatcatcagaatgctgacgttctcccgtttgatcacacgggacaggcgtgacatatccagcacggtatctttcgggacgatcacaagctttgcaccgtttaacagcgaaccgaacatatcaaacataaaagcgtcaaaaacgtagtttgacagaccgagcactgtgtcctcttcagaaacagtcaaatagttcgtgttttttaccgtccgcaaaatgttggcatgtgtgacgatgtttcctttcggcgttcccgtcgtgcctgatgtataagtgagattggcaatcgttttggaatcaaacggcaatgctggattgtgagagtccttttcatagctcgcctcatcatcagcaagcacaatgacgccttgaaaaccggccttttccgcaagcggcttgaggctttgctgagtcaggagcacattcgccccgctgtcgcggaagaaatgctgaatccgctgaaccggatgctcaggatcaatcggcacataggcggaccccgcttttaacacagccataatggaaacaatcatatccattgaccgttcacacagaacagccgcggtttttccgccgcctccgaccgaaagaatatgccgcgcaagcatgttggcgcgttcattcagctgctgatacgacagggtttccccttcgaactgtagagccgtccggtcagggttctttcggacttgttcttcaaagatctgcacgatcgtttgatctttcgggtataccgtgcgttccgggttgaaccgctgtaattgattcaaagcctcccgttcagaaagcagatcatattcgctgattttcgcatccggctgagctgccgcgctttccagcagacggacatagtgcgcaagcatgcgatccgcagttgagcgcttaaacagcttcgtgcaataatccaaatcaagcgcaatgccttccgctgtttcccgagcctgcatggtcaggtcgaatttggcgatattgaagtttgtttcatgaagagacagcgtcagattaccgatctccgcaattccgtccgaagcattttgcagactgaacatcgtgtcaaatatcggatgcctgctcatgtcccggggcacgttcagctcctcggtcagccactcaaacggataatcctgatgagaaaacgcatccagcacctgcttgcgcacatgacctaacaagccggcaaatgtctgatcctgcttcacggagcttcgcagcgcaagcgtgttgacaaacatcccgataagcccctcggtatcggagtgatttcttcccgctgacggtgttcccacgatgatgtcttcctgtcccgaatacttagaaagcagcgtatagtatgctgataacagcaccatgtaaagggtggctccgtttttctccgcaagcttccgcagccgttcccgcagcattttcggcagcttggcggacacgcggtcaccttcaaagctttgcacctgcggccgcggataatcagggagcagctgaagcaccggcagttctccgctgaagacttctttccagtacgcccgctccttcttgtagccttctttcgcccgttccgcctgccatacggcataatctttatattgaatgcgcaattcaggcagctgatttccgccgtagatgtcagccagttccttcagcatgatggaaatagacaccccgtcagaaatcaggtgatgcatatcaaacagcagcatatggcgattgtgaccgagcgtttgcaggccgattctgaacagcggcgcctcagataaatcaaaacggcgcacaaagtccttcatgacctgttcattcgttcttccgcgcgcttcgatcatttcaatatgaaacggaacatgctcgccaatcacttgtctcggcgtgccgtcctctgattgaaacgatgttctgagcgcttcatgcctgctgattaaggcagaaaatgcacgctcaagcttttcacggtctaaagcgccctcaatcatggccgcagccggcatgttatatccgactcccgcgtcttcaaattggcttgcgatataagtccgctgctgagcgagcgaaagcggatagctcgcctgcttctcagccggctcaattgcactgaatgccggtccttcgtttcggttttccgcataatcggcaagcgccgcaatcgtcggatgctcaaacaagtattgcagcggaatttcaacgcccatttgcttatgaattttcgtcagaagcgtcattgcctttaatgaatgaccgcctgactcgaagaaatgatcataaatgcccgccttgtccattccgagaacttcctgccagatgacggcaagtgtttcctccgtttcatttcttggcgcggcatattcagatgagctgacagcctgcacatcaagcgcaaacagctttttgcggtccgccttcccgctcggcgtgagtggaatttcgtccgtttttgtaaagtaagcgggcaccatgtaatcaggaaggtgcttggacacatactccctgtactcggcagggtgaaactcggttcctttttcctgaacgatatatgcgcagacatctaagctgccctgctgatccggccgtgccagcacgacggcctgcgccgcgcccggggcttttctgagcaccgtttcaatttctcccagctcaatgcggtagccgcggactttcacctgatcatcttcacggccgatatattcgatcgtcccgtccggcagccagcgcgccatatcacccgtgcggtacatgcggccgcttccgttaaacgggtcctgcaaaaacttctctgcggtcaaatccggaagatttaaatagccgcgtcctacaccgtcacccgcgatatacagctcaccggccgtgccgtcgggctgaagccgctggtgcttatccaatatatacagacgggcgttgccgagcggttttccgatcggaacgtacgccgcctgttgattcattccgttatccgctgacatctgatgcacggacgcatctacgcacgtttctgtcggcccgtagacattcgtcagacgcggcgtcctgcccgattgatgaaagagcgtcatcagctgttcagcaacagtcgcggacagaccctctcccccaatgagcatgtggcgcaattcaattccgctgacatctcccgccgcagccatcatctgcagatgcgcaggagttccgtcagtggcttcaatccggttttgacgataatagtccagcagtgccgagccattcgttacagtcgttttcggcacgatataaagcgtctgtcccaaaagaagcgaggcaaatatctgtttgacggacgcatcaaaatgaaacggagccaaaagcgccattcttaacgtctgctcaccgcattgataaatctcctgctgcagtgattgcaccagatgatgaacttgccggtgctcaatcatcacgcctttcggccgccccgttgtacctgacgtgtagatgatgtaagccagccagtctgattgtgtgctgacaccgtccacagccgtctcatactgaacagcctcgtcaaaatcaatccgttcggcatccgctgcaggcgcctgtattccggcctccgtcagaacagccttcgctccgctgtcctccaaaatgtactgaatccgatccgccggaaagtcaggatctatcggcacataggcgccgcccgctttcaaaattcccaatattgccgcaatgacacgctcagaacggccaagcagcaccgcgacaggagaatcggctgatatcccggcttgaagaaggcgtccggcaatacggcctgactgttcatgcaatgtgcgataggacaatgttcggccttcatacacaaccgcgggtttgtcagacagtgacttcactttctcttcaaacagccccggtatcgtcatctctccgcggtaattcaccggattgccggaggcccgtttcaacagccgctctttctcggattcagaaagaagagtaagttcatcaattatgcgatcaggagatgaaatcgcatcttcaatcagcgtgatcaaacgttcagaaacagattcaatctcttcccccttgaaaatgtcgctgcgatagtcaaaatcaattgtcaatttcccggtgtcccatcgttccttcacatgaattgaaatatcatttgtaccgcttccgctgaaaatagggtctgtcaggaaggacagattctcttttttctgccactgcatcacctggtactccagagccaccgtaaacaatctgctcagcgaacttttcgaagcgcgcaaatcattgacaagcaggttatacggatacttttggtggcggagaattttcatcagatccttcatccggcctttaacgaattccaagaacgactgtcctccgtcaacgcttgtccgcacaggcaccgtagatacgaacatcccgagcatctgcttttctttcgcattcgtccggttccccataaacgtacccgtgacaacgtcatcccggccggtcactttgtagagataagtgatcagagctgactggaacagagatagtacgctgactttatgctcctcgcagaatgaatgaatgcggccatataagtcgtgaggaatttcttgagaaaaccgttttgcatcaagacccgcatctgcctggctccgtttcagggacacaagctccggcacggtctcaaactgcccgttccaaaaatcccgatcctttttaaaccgcttcgactgcacatattcctgctctgtcagcacgtgctcgataaaagaaggaatctccgtttgttcctcacttgctccgcctgagagctccaaataaatatcggtaatcgcattgcccagaatcgtcatggaaatcccgtctgaaataatgtgatgcacattagcgtaaaaccagacctcattttcactgatcgtgtgcacggaaaaacggaataaatcctgatcatataacgccagaggcttgccagcttcttcacgcccccatttggacagctcgtccgcagagcagccggcttgcctgatatctgtgtgcccgatagagagcggacggtattcgctcacatattgaacgggctccccctcatcatcaagccgcagccggattctcatcgactcataccgccggacgaattcctgtatcgctttctcaacgtaatgagcctgtacgccgtcttcagaaatgagtttcccgaacccggcaagatttgaaatacttgtgttcggatagaatttttctgtataccagatacgtttttgagcatttgttaaaggataaaaagttatttccatatgtgtgcgcctcccctttttaagataaagatgtcaattctcccttagaaacagcctccctctatgtccctaactcattctcaagccaaaagaaccacttacctccaaaaacgatcccgattcaatcaccgccgaaatccgtcatccgttcacccgcgcagtccgaaatgcggcatcaaatttatgagaaatcaagacaaaaagccattgattgtaagcacgaaaggtttacctatttctgcatgtatttctatatatctacttacgttcactttatatgaaaatattgtttttatcaccgaaaaatgggtgaaaagtttcatgcggcacaccgaaaaaaattccgacaaatccagagggtattttgcggcatcccgcaatttattttcaaaaatattatttacgtaaaattaaaaatctttaaactataatgaaaatctgtcgaatatccagttatggcagaatgaaaaaaatttacgtacgtaagctgacccggaaaaaaaagcgcaagaaccgaaacagacagtccgaatgttcgcaatatgatttcattaaaccgcaaaaaaagcactctattttacatagagcacttcaaaaagattcctttattgcagttttatcaatgttgattaattccatataatcttttccccacttatacatggcgtccagaatcggcataaggctttctccttgcgccgttaaagaatactccactttcggagggacgacagggtaaacttccctgtgaacgatcagatcctgctccagctccctgagctgattcacaagaattttgtgcgtaatatccggaattaaagctttcagctcattaaaccgcttcgtcccttcttttcccaagtgccacataatcagcattttccacttcccgcctatcacggcaagcgtcaattccttttcgcaattaaacgttttctcatccattcggctcacggacaatgctccttcctcttactttttgtacggtcatcatctattcatacacgcttactttttcacacaactttcatcagtttatactaccacgcagttttgctgaaacaaagcgcattgcctgcggggacagtatcctcaaagtaactattagacttcaaagtgcgtacttctcaacatgcggggcactctatagaatggaaatacataaaaaagaggagtggatataaagtggaattacagctggcattagacttagtaaatatcccggaagcaattgaacttgtgaaagaggtcgaaccatatatagatgttgtagaaatcggcactcccgttgtcattaatgaaggactgaaagccgtgcaggaaatgaaaacagcctttcctcacttgaaagtgcttgccgatcttaaaatcatggatgcaggcggttacgagattatgaaagcggcagaagcgggagccgacatcatcaccgttttaggagcgacagacgactcaacgatcaaaggggcggttgccgaagcaaaaaaacagcagaaaaaaatcctcgtcgacatgattaacgtaaaaaaccttgaaacacgggcaaaagaaattgaccagctcggtgttgattatatttgtgttcacacaggttatgatcttcaagcagaaggaaaaaattcatttgaggaactgacggcgattaaaaaagcggtcaagagcgctaaaaccgcaattgccgggggcattaaacttgatacgcttcctgaagccatcaaacaaaacccagatttaatcattgtcggcggaggcattacgggagctgacaataaagcggatgctgctgctaaaatgaaacagctgatcacacaaggatcatgaaaacgactgaatacttacatgaaatactaaatgaaatatcccgcaccgcagcattaatatccgacagtgaagctgacaagcttgcgaatcagattttatcggcagatcaaatcttcacgtccggagcgggacgttccggctttatggctaaagcgttcgccatgaggatgatgcacatcggtctgaacgcttacatcgtcggtgagacgcttactcctcccctccaagaaggcggtctcgtcatcatcggctcaggctcaggcgaaacaaaaagtctgcttcatacagctgaaaaagccaaaagccttaacggcatcatcactgcattaacgattaaccccgactcaagtctcggcaaacttgcggatcttacaataacgattcccggctctcctaaggaagagaccggcggagacagaaagacgattcagccgatgggttctttattcgaacaaactcttctgctgttttacgatgcggttattctaaaaatcatggagaaaaaagaattgaattcagcagacatgtttacaaagcatgcgaatctggaatgatttgctgacggccttcttatcagatggccgtctttttatcgtcttgttgcgcacggtcatgcagaccaaggttttcgggtcggacactcgcagacgaagatatcctgccggtgagcttatcgctataataagtcaattgacgatacacccgcaaccgttcatttctgaatagggaaactgcaaaaaacactttctgattgaatttttaatgaataaagttgatttgtgcggatggttttacagatattcagctgaattgcggctgagaaatatattttaacagctttacagccggccgattctgctttattcttggaccagctttacagcaattaaaactggaggtgattgatactcttgaaaacattaaaagcactgctgcttgttcttatcatcattgccggagcagtcgcggccctgatcaagggtgatcttttctcagataacgagcagaccgttcagaagagtcattacgacaaagtaatcttatttccgtccgatcgatatccggaaacagcaaagcatattaaggacgcgataaaagaaggacattccagcatatgcaccattgacagagacggagtacataagcggcgtgagcaatctcttaaacatgtgcccgtcaaaacgggatacgatagagatgaatggccgatggcggtttgtaaacagggcggaaataatgcctccgtagaatatatttctccggcagacaaccgcggagccggctcttgggtcggacaccagcttaccaatgatcccgacggaacgagagtattatttaaaatcaagtaaaaaacaggaggaacagcgcattgaataaatcatggaaaccgcaagaactggccatttcttatcatcaatttacaatcttccaaaaagattcagaaccgcctgttatcgattggaccgatgaagccattgaaaaaggatatgcggaagctgacggagctgtttcatttgaggcaaggagaaatacgagggcatttatcgtcctcaggcttaacacaagtgaaccggtaccatcctatgagaaaaaagcgactgttccctttgaggctgtaaaagatggaattgagattgaaagcgtgatgtcaaagcggctttcttttaatattccgaaaggccgatacagccttacctgttattcagtgcctgccgaattatccgatcttcatgcggatacgtatattattgatgcagccgcaatgtaaaagaaatccctgagagaatcttatttctctcagggaacttttataaacttttaccgtttgtttcaattacattctggtaccaataaaaactttttttcctgatccgtttcaaatccttttcatcttcttcatctcgattgatatagacaaaaccgtagcgtttttgatagccgttcagccagcttaacagatccgtgaatgaccagctgcagtagccgatgagatgaactccgtcactaatggcctctctgcactgttcaagatgggagcgtaaatagtcaattctgtagtcatcctgaattgagccgtcttcttctattttatcgaattcccccagcccgttttctgttataaaaaccggcagctcatagcggctcgttatacgccggaggccgatgcgcagacctatcgggtcaatcgtccaatcccaattactcgtcacgaggttcggattctttttcgttttaaacagacccggtataccggtatcctggtttgtccctttctgaccagtcgtgttcattttcccctccgatacaccatcaagaggatttctttcgtacgtaatcgtctgataataattaacaccgataaaatccggcttgccttttgcaagcaattccatatccccggcttcaatggcgggcgcccagcccttttcctttaaataattgaaaggaatttgcggataagtcccccggcaatacatatcaagccaccaatggttcataaattcctctgcgttttcaaatgcagttatgtcttcagggtgacttgtaagcggataagccggtgaataagcgaagctcgggccgatcatgccgccaggaacatattgtctgaaggattcaatcgctttggcattagctaaaaatgcgatatgattggcttcataaaatcgttttctgtcctttacgccgggcggatgtgcagctgtaataaacccgttatgaaaattataattctgctcatttaacgtgacccagtatttcaccttgccggcgaatcttttgtataacgcaatgcagtaattattaaaatcatcaataatttttcttgattcaaagccgccgtattcatccatcagcgcctgaggcaagtcccaatgataaagagtcagcaccggctcaatatcgttagaaatcaattcatcgatcaggtcttcgtaaaatgcgatccctgattcgttgatttcccctctgccattcggaaaaattctcggccagctgacagaaaagcggtaagctttcaaacccatttctgccatcaaggcgatatcttctttataacgctcataatggccgactgctgtatcgccatttgagcctttaaacgttttacccggtattttcgtgaataagtcccatactgaaggtcctttaccgtctttattccaggctccttcaacctgataggcagccgaggctgacccccatagaaatgtatcagggaacaggccctgttttttatgtatcatgtgtctcatcctcctgatgcgtatgatattgatatcatacgttatgaaacgcgtttcagagcaatcccgataaaaacaaaaaagcatccggcttgccggatgcttaagaatgatgatgccgcttttccaatttatgaggcggaggcttcgggacaaacccattttgtttcatcatgttaaagcgcctgtccatatgctgtttaatatgttctgctttttctttcggcaggaccccgtactcaacatatttggatatgacatgttttcgtttttcgagcacttctttttcaagtgattcaatttcttttttctgctgttccgtgagtgacatggttgaaggcatttttgttccggcggcgtgtgccggcattgtgaaaaccattgctgtaatgaaaaacgcagctaaagacaatgcagcttttttcatgactctttcctcctttaacgtttgttatatgttgctccctcatccattttttatgcaaaaaaagagcgaaattattcgctcttttcaatcgattcgtccggcagcgcgtatgtgacatacgttcccgctacaaaatcgtggattgaccgtctgtcttctctcattccgaccatgaatgcgctcacgatcacaccgattccaaacgtcacgccatatatcaggccgcccacaagcactctcaaaatcatagtgaggaagcctacctgagtgccgtcttttttgacgatgcggataccgcagatctttttgccgataacataaccgttccagtatacagggagcaaaatagcataaagagtcaaaatgatgctgatcattgtgctctcattcggatcttttcctgttgccagcataaaaataatcgccaaaggcactgaagtaattaaatagtcgagtaccacggctcccaatctgatccaaaatcccgccggtctgtaaatattcatcgtgtttctcctcgctatggctttaaaatcactttaatgttgccatcttcttttttgtcaaatatatcatatgcagcaggagcttccgcaagactcattttgtgtgtaatgatatccgtcggatcaatttcattttgttcgatcatttgatacagcatcggcatcagatgaataacgggtgcctggcccatttttaaagaaacgttgcgtgtgaaaaaatcaccgagcggaaagccgtccgcttcagaaatgtatgcgcccgtgagctgcacggttccgaacttcttaacggcttctgatgctgtaagaatcggactgatcgttccgaactgattcggtttttgctctgttttttcttttgaaagcggcgtgccgtccattccgacacaatcaatcactacatccgcgccccctgacgtttgttcatgcagcagtttcccgatctcatcatgttctgaaaaattgaaggtctctgctccgtttatgcgtctcgcatgttcaaggcggtgcgggacttgatcaactgcgataacccggttagctccttttttccacgcgaatttttgcgccattaagccgatcggacctgatcccagaatcacgactgtatctccttttttcactccgctgtgctggacgctccaaaaggcggtcggcatgacatctgacagaagcagcacctgctcatcttcaagctcactgtctgccggaaccagaaaagaagagaaatcagcataaggaacacgtaaatattcagcctgcccgccgggataattaccgttaaactccgaaaaaccgaataagccgccggcatctgtatgaggatttggattagattcatcacactggctttccatctggtgcttgcaataatgacattctccgcagccgatgttaaaaggaatcacgacccggtcgccttttttcagctttttgacttgactgcccgtttcttcaacgattcccatcggctcatgcccgacgatataacccggatcggcgggtattccgtttttatataaatgaaggtctgaaccgcatatcccggttgcggtgattcgaacgatgacatctctctcatcttgaatggcgggtgccgggacttctttcacttccatatgttcttttccttggtatgtcagtgctttcacacttggtcagctcctttttcatcactccttcccttttcacctgcttctaaacttggccggtatgttattcggcccgctgaatatcccattgaaaaggttcttcaagctgcgaccagtcggaatcgaactcagacggcgtgagcaggcactgatccaattcctttgtaatggctgcttcatctaaatctgttccgataaacaccaggttcgtatgacggtctccgaattggtcgtcccaatcttccagaatctccggttcctgctgtttgatctgctcctgctcaagtttcggcattgccgccacccaataagaaacaggctcaatcgaaaccgccggacccgcctgagacatcagcagcgcaaggctgttgcgggttgcgcaccaaacaattccttttgcgcgcacaatgctgtcaggcattgattgatgcagccagctatcaaaacgagcggtatgaaacggcagacgccgcgagtacacaaacgaagtgatgccgtactcttccgtttccggagtgtgcgcttcatgacctgccgtcagctcctttatccatcctgctgatgaactcgcttcctcaaactcaaataaaccggtattcaatatgcattcggcaggcacttctccgcggacggaccggatcagtctggcgcggggctgtaatgcgcgaaggaccgtttccagctgttcaagctctttttcgcccaccatgtcgcatttatttaaaatgagtacatcacaaaactcgatttggtcaattaataaatcggcaatcacccgttcatcctcttctcctaccgcttccttccggtcaagaaggctgtcaccggactggaaatcatgccagaagcggtttgcatccaccacggtcaccattgtgtccagcctgcagaatgttgtcagatcaatgcccatttcttcatctatataagaaaatgtctgggcaacgggaatcggttcgctgatccctgttgattcaatcacaatataatcaaatctgccgtctttcgcgagtttctcaacttcgactaataaatcttcacgcagcgtgcagcagatacagccgttggataattctacgagtttctcatccgtccttgacaagccgcctccctgcttcaccaagcccgcgtctatatttacttcgctcatgtcattgacgatgacggcaatttttaaaccgttgcggttttgtaaaatatgattcaaaacggtcgtctttccggcaccaagatagccgctcaatactgtaaccggaatttttttcataaaatagcctcctgacaaaatagaatgattacgatttataccccgcacctgccttattatcatcatgatgtacattattataaatcgtaatcgttactatttattctgatgtattctccgtttaaaatcaagtgaaaaataatcaatcataaaaaagacacgctgtcatacgtgtcttccgcccaaacttaaacatccgcaggactgttttcagtgccacagctttttctccaaaaatagcctgcggccagaacaagcacaaatgcgagcaatgtgatacatgagaaagagataaaaccgatcgcataagttcccgtcatctgcttcaatgatcctaaaatattcggaaggaaaaaaccccctatgccgccggctgctccgacgattcccgtcaccattccgatttcttttgcaaagtgctgagggacaagctgaaataccgctccgttgcccataccgagcgccatcattccgataaacagcagaacgatcaccgttgaaagcggaggcaggctgctgactcccgccatacacagagccgcgatgacaaacagtacagccagaactttcgcacctcccgcccggtctgaaatccagcctcctgcagggcgaaaaaaactgcccgctgcgacacatattgtgacgaaatcaccggcatggatttttgacaattgatattgatcaacgaaaaaaatcgccaaaaaacttgataatcccacaaaacctccgaaagtgacgccgtacagaagacagaaacaccatgtttccttctgcctgaacacgtgaaggtagtttttaagcggctgcggtgcgggctgtgcaggagagtccttcgccatgacgataaacagtataaaaacgatcatcaacggaagaagcgcaattcccattacactgtgccacccaaactgttccgcaaggcggggaccgaacaatgtcgcaaacaaagtgccgctgttgccggcacctgctatccccattgcaagcccctgcaagtgaggcggataccaccggctcgccatcggaagcgcaacagcaaaacttgcgcccgctacgcccagcagaatgccgatcgcatacagctcagtcaaagaacggccgccgaatgccccccaaagcagcgggatcatcgtgatcagcatcccgatcacggctgttttcttcggcccgatcctgtccgttaacacacctaaaatgatccgaaacacagatcctgataagatcggcagagccacgacaaaccctttttcaaaagaagataacccgaaatcctgagaaatataaacgccgagcgcccccagcattacccaaatcataaaactcacatcaaaatataagaaggaacagagcagagtgagcggatgaccgcttgtttttaattccgacagcttcataacattctcctttccggtcttctatcatttcaaattgctgaatcaagaatatatgacgggcattcaccggaaaagacatgtgtaagataatgcgacacatttaatgcgttaatcaggcaatgtgccataatttctcatagagaagcaatcttactggcagctgcaaaggaggtttggcgaatgaagaaacaacgattaattgcagcagggaacggaatggccggaatccgctgtattgaacacattttaaagatgaaccgtgacatgtttgagattgtcattttcggaagcgaacctcatcccaattacaatcgcattctcttatcctccgttttacaaggtgaggtttcgcttgatgacattacgctgaatagccgcgaatggtacgaaaaaaacggaattacgctttacacgggagaaacggttgtacacattgatacagaacggcaggttgtcacaacggatcgaaagcgcagcatgacttacgatcaaatcatccttgcaacgggctcctctccttatattctccccatacccggagcagataaagaaggtgtgtacggctttcggacaatagaagactgccaatcccttatcaatgcggccggccggtatcaaaaggcggcggtcatcggcgccggtttattaggtcttgaagcggccgtcggcttacggcagctcggcatggacgtcagcgtcattcaccactcttccgccattatgcaaaaacagcttgatccaacggcatcccgcctgctgcagaaagagctggaacgaaaaggcttagtctttcttttagagaaagacacggcatccattacagggaactcacgggcggaaggcatccgtttcaaagacggttcttccatagaagcagacctgattgtcatggccgccggtgtgaggcccaatatccgatcggctgcatctgccggactttcagtgaaccgaggaatcatcgtcaatcaattcatgcagacgaacaaaccgaatgtgtatgccgtcggtgaatgcgcggagcatgacgggattgtatacggattggcggcgccgctttatgaacagggaaaagtgctcgcgcagcatctatgcggcgtcccgtgcgaagggtttcaaggctttgcacaatctgcagccttaaaaatagccggtattgatgtatggtcggcaggaaaggtgcacgaggatgagcacacagccggcatattgttccatgatgagcatgcaggcatctacaaaaaagcgctctttgaggacgataaaccggccggctttattttattcggggacacgcgcggtaaacagcggcttctcgacagtcttgtgaagcaaagagatatttccatcgtgaaaaaacagctcatggaaccggatcaaggcggtatatcctttgaatccatgcctccccatgaaaccatttgccaatgcagctcagtgaccaagggctccattgaagaagcggtgaacaaatatggcttaaaaaccgcggaggaagtgaagcacatgacaaaagcgtccggatcttgcggaggatgcaggccgctcgttgaagacttgctgaagtatatggcaagcgatgattacacaaaaccctcccgccagccttcgttttgcggctgcaccgatttgacggaagaagaagtcatcgccgaaattcgccgccgtccgttcactgatgccgccgaggtaatgagagagatcggctggaaaacagaaaacggctgccgcatttgtattccggcgcttcactattacttggaaaggacgcggcctgattttatgcagttcaatgaaatatcggcagaagagacatgcaccctgattccgcaaatgtacggcggactgacaagtgcggcagagctcaaaaacatcgcagacgtcatcgaagcatacggcatccccgaggtttcgatgactgacagtcaccggctgaggctttccggaataaggccaaatgaccttgcaagcatcagaaaagcactgaacatgccggttttctccccccggcaccgctggacgatgcaaatcaaagcatgtacgtgcggacagcatcgctcctttcaagagctggcaagcaggattgaacgagataccgacacgcttgccgtacccgcttatgtatccgtcagcttgtcatgtgaaaacaattgcaccgatgcttacattcaggatatcggcgcgcttcagacacaaacttgctgggagatttatatcgggggcgtccgcggaaaacaagcccgcgccggcagccttttttgtgtgacggataacgaagacagtaccgccgctatgatgaaaggccttattcaatattatcgcgaaacggctcactacaacgaagcgatttatcaatgggttgacagactcggcctcgtccatatcagagaaatgctgtttgaagaagatatgcggacacagcttctgaaaaatctccgttcagacatatccctgctgcaaaacctgtctgccgggaaaacgccatacgaaaggatgaagctttttgactgaaccgatgctccgttatttccgtgacaaactgcaagatattcaatcggaaaaaacatatgagacgcaatgcccgttctgcagcatgcaatgcaaaatgcagcttacggaacaaaccttcgcggcacggaagaaatacactgcaatcggcattgataatccgacgacacatggccgtttatgtacaaaaggcatgaatgcccatcagcatgccgtgcactcttcccgcattacacgccccctgcttaaaaaaaacggtgaatttgtgcctgtctcttgggctgaagcactgaatcgcataaaggaacaaatcaatctgatccaaaccgaacacggcaatgatgcgatggccgtctacgggagcgcctcaattacaaatgaagaagcctatctgcttggaaagttcgcacgggtcggcttacagacgaaatacatcgattacaacgggcggctctgtatgtctgccgcagcaacggcggccggccagacattcggcgcggacaggggcctgacaaatccattatcggacattccgcatacacgtgtcatcatcctggcaggcaccaatatcgcggaatgccagccgacaatcatgccatattttgataaagcgaaagaaaacggggcttacattatcgccattgatccccgggaaacggcgacgaccaaaatagccgatcttcacctgaaaatcaagcccggtacagacgccgccttggcaaacggactcgtcaaaatctgcattgacgaacagcttacagacaaagactttatccgcacacgaacaaacggattcgataagctcaaacggcataccgacgctttggatctgaaagagatctccgagcagacaagtgttcctttggagcatatacgaaaggccgccgtgaagtttgccaaggaaacatccggcatgctgtttacagcgcgggggatcgaacagcagactgacggtaccgcggcagtgaaagctttcttaaatatagtgctgatcacgggaaaaatcggcaagcccttctcaggttacggggcgattaccggtcaaggcaacggacaaggcgcgagagaacacggccaaaaagcggatcagcttccgggctaccgttctatcgaaattgaagaacaccgggcgcatattacgaaggtgtgggggattcatcaggatgagctgccgcgaaaaggcgtctcagcctatgaaatgatagaaaaaatagatagcggcgacatcaaaggactgtttctcatgtgttccaatccggctgtttccggcccaaatgcgaatttcgtcaagcaggcaatcaagaaactgagattttttgtcgcagttgacttatttatttctgagaccgcggcattcgcggatgtgattttacccgcctcctcttatttggaagacgaaggcacgatgacaaatgtagaaggccgcgtgacattaagagaagcgagccgcacctgccccggagaagcgaaacatgattggcagatcatctgtgacattgcctccgctcttggtaaagggcattatttttcctatacgtcggcggaggaaatctttaacgaactgagagaagcgagccgcggcggaatcgctgattacgcaggcatcacctatgacaggctcaggcgggaaggcggcattcagtggccatgtcctgaagcggatcaccccggaaccgggcgattgtttgagcactcatttgcccatcccgatcacagagctgaattaagcgtgattccaaatgaaccggccgtcccgaaagagaaaccgagcgccggctatccgctttatttaaccacaggaagggtgatgtctcattacttaacgggtgtccaaacgagaaaaagctccgccctggctgcaagacatttcgaatcctttgtggaaatccatccaaaaacggcggccgactatcatatcgaagaccgtgttctcgtgaaagtagaatccccccggggcagcatcacggtccggagcagatggtcggagaaagtacgaaaagacacgttgtttgttcccatccattggtctgacacgcaaaacgtcaacgacttaattggtgaagccttggatccggactgtaaaatgcccggttttaagatgtgtgcggtacgaatcagccctatataatttttcataaaatttttagattttttagtattttttgttacatttcataacatgcatcttaaatatttgtttttgctgtgctacgctaaaaaaaaacaaagataaggagcggatcatctgatgggaaaaaaacagctagtccttgttggaaatggaatggccggggtaagagcgattgaagaaatactgcgtgtttcaaaagacgaattcgagattacaatattcggggccgaacctcatcccaactataaccgaatccttctgtcaaaagtgctgcaaggcgataccgacattcaagacattacgttaaacgattggaactggtacaaagaaaacaacattcagctgtataccggtgaaacagtcatcaaagtcgacacggaaaacaaaaccgtcatcaccgatgcagacagaatccagccttacgatgaactcatcctggcgacaggctctgtcccttttatccttccgattccgggcgcagacaaacaaggcgtcacggcattccgggatataaaagatacagacacgatgctcgccgcgtcaaaacaatataaaaaagcagccgtcatcggcggaggactgcttggtttggaagccgcacgcggactgctgaatctcggaatggacgtgtctgtcatccacctcgccccattcctgatggagcgccagcttgacgcagcggcgggacgcctgctgcaaaacgaattagaaaaacaaggcatgacctttttccttgaaaagcaaaccgaagaaattctcggtactgaccgtgtcgaaggcgtacgcttcaaagacggcacaagcatcgaagctgacctggtcgtcatggcggtcggcatccgcccgaatacacagcttggcacagaaagcggcattccggtaaaccgcggaatcattgtcaacgattatatgcagactgacattccgcacatttacgcggtcggtgaatgtgccgagcaccgcggaatcgcatacggtcttgtggcgccgctctatgaacaggcaaaagtgctggccaaacatatttgcggcattgaaacaaaaccgtatgaaggctccgttctctccactcaattaaaggtatcaggcgtcgaagtcttctctgccggtgactttaacgaatcagaggacaaaaaagcgattaaagtgttcgatgagcaggacggcatttataaaaaaatcgtcctgaggggcaatcaaattgtcggcgctgttttgttcggcgacagcagcgagggcggccgcctgttttctatgattcaaaaagaagccgatatctccgaaacttccaaaatatcaatcttacagcctcttgatcaggaagcaggcgcaagcatgaccgcggcgatgagcgacgatgaaatcatctgcggatgcaacggcgtttcaaaaggcgcgattattcaagccattcaggaaaaaggctgcacatctacggacgaaatcaaagcatgcaccggggcatcccgttcctgcggaggctgtaaaccgctcgtggaagacattcttcaatatacactgggctcagaatttgacgcgtccgcgcaaaaagaagcgatttgcggctgcacatcactgtcgagagatgaagtcgtagaagaaatcaaagccaaagggctgtcccatacaagagaaatcatgaacgtgctcggctggaaaacgccggagggctgctccaaatgccgtcctgccctcaactactacttaggcatgattaatccggctacatacgaggatgacagaacatcccgttttgtgaacgaacggatgcacgccaatattcaaaaagacggaacatactcagtcgttccccggatgtacggcggcgtgaccaactctcaggatctccgcaagatcgccgatgtcgtcgacaaatatgagatcccgctcgttaaaatgacaggcggccagcgaattgatctcatcggcgtcaaaaaagaagacctgccgaaagtatgggccgagcttgatatgccttcaggctacgcgtacggaaaaacactccgcacggtaaaaacgtgcgtaggcgaacaattctgccgcttcggcacgcaagactccatggcactgggcattgcgcttgagaaaaaattcgaagggctcaatacgcctcataaggtcaaaatggccgtgtccgcctgcccgcggaactgtgcggaatcaggtattaaagaccttggcgttgtcggcatcgacggaggctgggagctttatgtcggcggaaacggcggaacccatttgcgcgccggtgatttgctgatgaaagtaaaaacgaatgaagaagtcttagaatatgcgggtgcttaccttcagtactacagagaaacggcaaactatctggagcggacatccgcatggcttgagcgcgtcggtttatctcatgtccaatccgtattaaacgatccggaaaaacggcaggagctcaacgacagaatgaatgagacactctctgtccacaaagatccgtggcaatacttccttaaagataaaaaagcatctaaagatctattcgaaaatgtcgtcacgacttcataaaacagtaagggggaacggacatggttaataaagatatgacaaaggtttgcataggcaaagtaaacgaattacccgaggagttaggaaaaaccgtatatatagaagataaagagcttgccgtatttaaactttctgacgggagcgtccgcgccgtcgaaaaccgctgtccccataaagggggcgtcttggctgaaggcatcgtcagcggagaatacgtcttctgcccgatgcatgactggaaaatctccttagaagacggaaaagtccaagagccggatcatggctgtgtcaaaacatacgaaacactgatcgaaggagagaatgtatacctcctgtattgatcagaccggatcactttttcaagtggtccttcattttttaaactgctgaagggatgacgccatcatgaaaaacggaatcgtatattttgtcggtgccggaccaggagacccggggctgatcaccgtaaaaggaaaacaggctctggagaaagcggatattattttgtatgaccggctcgcaaacccaaagtttcttgagtatgcctcaccggactgccggttcatttattgcggaaagctgcccgaccgccattttatgaaacagtctgagataaatgccctgctgattgaaaaagcggcggagggctgcaccgtagtccgcttgaaaggcggagacccaagtgtgttcggcagagtcggcgaagaagcagaggcgcttcatcagcacggcatccgctacgaaatggtgcccggcatcacctcgggaatcgcagcgccgctgtatgcgggagtccccgtcacccatcgtgatttcgcttcgtccttcgcgatgatcaccgctcatgatacatcattgcacggcaggccgaatctcgactgggaagggcttgcccgaagcgttcaaacgcttgtgttttacatgggcgttaaaaatctgtcatttatatgccgtaagcttacggagtacggaaaatccccttccgttcccgtactcgtcattcaatgggggacgtgggggcggcagcggagtgttaaaggaacgcttcaggatatccatgaaaaagttcaaagccaaaacatcaccaaccctgccattatcgtcatcggtgatattgtcaattttcaaacacacagctggtttgaaagcaaaccgttcatcgggcggcatatcatggttgtcactcatggcgatgaagaacacacattgacagacaagctgcgcgaatatggcgccgatgttattgaatggccgaagcggatcgttaaaaaaatgcccgcaaacgaaaacatcctgaaacagatcagcacctttgaacaactatttttcacatcacgccttgcggtatgcgaattctttgacacactggctttcaagcagatcgacatccgccgggtgaccgcaagcctgaatgcagcgactgaggccgcaaagacggaactgacaaaacggggctttctcctatccgaatgtcaaattgattctccgcattcactcattgtaggaagccgtcaagcagcagaaaacttgtcagactcaaaatcatgcccgttttatatcacccatgaacatatcgcagatgagcggttcacttccatgatcgaacgcacgatcagcgagtctcctctgcaaatgattatctgtacgggcaaagaatccgctcagcatttgatcagcgccggaaaacaaatcggcatatcaccgaatccgtcaggaaaccgccctcccgtcatctgcatgggcgaagacgtccccgccggctgcgggtttaccgccgtgaaaaatcaggaacagttatttgcgtttatacgaaatgaaatgaaagacatgctcgttcacagctgatacgccggaatttctgacccccgggctcaatatcgggggtcagcccttttttattgtgtcaccaattttttatggtgagtcgaatacatcgccatctgttccgcctgcgggtccaaataggctttggcgctgttcacggcggtcggcccctccgtgaaaccgccggcaatcaatctgagcttgctttcataatgggcggcgtcaccggcgacaaacacgcccggaagattcgtccgcatatgtctgtcagctttaatcctgccttcttctatctcaagcccccagtccttcatcggaccgagatcaattttaaacccatggttgataatgagctcatcaagcttgatgacttcagaaagtccggactcagtttggcaaacggtgacgctctcgatccgttctccggtgccgttgaggtgctttagacgatatggcgcaagcacccgcacggaagaccgcttcattttcgccacgctgctttccaaaccgccgaactcctccctgcggtgcaagacggtaacagacgccgcaatcggttccagctcattcgcccagtcaaccgcggtatctccccctcctgaaatcacgacatgcttatctcgaaacgcatcaagcttctccaccttataatgaaggttctttcccgaataccggctcgcatccgcgctgtcaagttcattgacctcaagcgtccccatgccgacagccaaaatcaccgtgcgcgtatagtgcttttcccctttggaactttccagcacaatggttccgtcttccagccattcaaatccggtcacccgctgattcaacacgatatccggcttaaatgtcgcagcctgttccttcagctgcttaatcagctgttctccggcaatcccgggtattccgccgatatcacggatgattttttcagggaaaaacatagacactttccctccgagccgcggcaaaaactcgatcactttcgttttcagctcgcgcatcccgcaataaaaagccgcaaacaggccgatcgggcctccgcctataatcgtgacgtcatacacctcatgattttccgccatcgttctgcctcccgtttatatctatacttcaaacatttttaattgagaatcaatatcaatgaaagtataacacatattgaggagaagtgtttattcatttctctcttgcggaaaaggagtgattcagaagtgaggttctgagattgataagcgggaaggtattaaaactgaaaccagtacggcgactggtttcttttttatctctttttcatcagcatgatatcgagatacagctggcaccttgtcctgaagtcgtttaaattaattgatgtcatgtcaagaatctgtttgatacggtagttcaatgtgttttgatgaataaaaagctgttctgcggctggttttgttttgcagttattgaggagatagatttctaacgttttcagcagttcggtactgctttctctgtctttggcttttaataacgctaaatcttcgtttacatattccagtgaggcgtttttttcttcgatgctttcaagatagcggtaaatcccgagcttactgtattcgtacgggatattttcctggtttccggtaatttcggcggcctttatgacttcaagggcctctatataacttttgccgagcttcaggatgctgctgtattcattgccgattccgatatagatgggagtggggatcttctgaaagtgaaaatgagtcagcagtttgtgggtgaattcagatgctgccgaagtgccggagcttttttgcgagaagcttgcgacgacgatgacaatattggaatcaatggttaagacgtgactgactttatcccgcaaattcaagtacgatttgatattttccttcacatcttcgactgcctccccatccccattcgcggcgtgcaggacgactactgaaaaaaccgacggcagcacggcgttcatcttttccgcttcccgcctgaactccttttcagaggagaattgctgaaagatcgcccgtttcaccaggtcttccgctctctcttctttttcctgtttcagccggttcgttttatagatgatttttccgacatggaatgaagtttcatataaaaaatcgagctcctcgtccgtcaagtttcggtcgagctcctgaatccagatgtagcccatcacttcgcctttatgttttgcgcttacaaccactctctgattcagtccgatactgtctattttttcgacacggaacggttcaggaacggttttcagcttttcgatcaccccgtccttcagaaacctttcaaaaatctgcacggggcatttttttgaaaatatcgtctgctggttggcggagtcgaagtgattaatgtaataagaattataggcaagcaaaaagaaatccgcgctttccagaataacgggcttctgcaattcataactgatgaaatcaattaatttatcaatgtccgtaaatgaaaaaactctctctaaaagctcttccatacctatttctcctatgctctttttatctttatcatactctgcggggtgactttttgtatagaaaaaaattcacataatcccaaaacggcatgatccggaattctgtatcgtgaaaagaggaaaaagggcggtcccttcttcctctcgttccttgcttttattgagaaagtgtatcacggtactcatgaaactgatctgtgacatcttttgacggagcctgtgtcaataagctgacgacaaatacagcggcaaggcttacagcaaagcccggaatgatttcgtacaaaaagtctgaaagaccggcattcgcccaaatgattacggtaatcgctcccgcaatcatgccggcgagtgccccccatttcgtcatccgtttccaaaataaactgagcagtacgaccggcccgaatgaagcgccgaatcccgcccatgcatagctgacaagaccaagtatcgtgttgtttttctcccaggcgagcaccaaagcgatgattgacaccgcaagcactgccattctccccagaaatacgagttccttatcagaagctgaacgcctgaacatggacttatacaagtcctccactaaagaactggacgtaacgagcagctgagacgaaatcgtactcataatggccgctaaaatcgcagaaatgagaaatcccgtaataatcgggtggaacagaatgttgccgagctgaataaaaatggtttccggatcagccagcttcagtccgttctggtggtaatacgcgattcccgcaagacccgtaaacagcgcgcctagtgcagacaaaatcatccatcccattccgatccgtctggcacgtttgatttctttcacagacgtgatcgccataaagcgcacaataatatgcggctgcccgaaatagccgagcccccacgcaaataaagaaataatgccaaggacggtcgtccctttgaacatgttaaacagttccgggttgacggaacggatatcggcaacggtttcccccgggccgcccgtatggaaaatcgtcacaatcggcacaagaataagcgccacaaacataatgatcccttgaacaaagtccgtccagcttaccgccaaaaagcccccgaacaaggtgtaggcgacaacgacgcctgtcacgacccacagtcccgtgtggtaattcaaccctaaaatgctgttgaataagacacctccggataccatgccggatgatacgtaaaatgtgaaaaagacgagaatgacaagacccgaaaacagtctgagaagcttcgtatgatcaccgaaacggttttcaaggaaacccggaatggtgatggaattccccgctttttcggtatacgttctcagtctcggcgccacgaaaagccagttcgcccacgccccgagcacaagcccgagcacaatccaagcgccgcttaatcctgtcgagaacatagcacccggaagccccatcaagagccatccgctcatatccgccgctcccgcgctgagcgctgtgacggcagggcctaaagaacgccccccgagcatgtaatccgtcagatttgacgtccgtctgtaggcgaaataaccgataaacagcatacccgccatataaatacaaatggaaataatcaactgaatgtttgctatggcatttcctcctccgctttatatgtttatggtgaaatggacaccccccgcgaggaggatgcccattcagtccctcttaaaacatttcactgattgttttcgcctgcatgtggagggccaaataatccgggccgcccgcttttgaatcagtgccggacattttgaagcctccgaacggatggtagccgacaatcgctcccgtacaattgcggttgaagtacaggttgccgacatggaattcctgtttcgcccgttcaatatgtttgcggttatttgtaatgaccgcgcctgtcaaaccatattcagtattgttggccacttctaaagcttcatcaaagtttgacactttagaaaacgccacgacaggcccgaaaatttcttcctgcatgagtcttgctttcggatcaagatcagcgaagatcgtcggcttgataaagtagccttttgaatcatctccggtgccgccgcttactaaacggccttcttcttttccgatttcaatgtagctcatgatcttgtcgtaagaaccttggtcgatgacaggccccatataaacatctgcactgtcaggtttagcagttacttttgattccgtaatttcaatgacacgctctaatacttgatcatacactttttcatggacaactgcacgtgaacctgcagaacatttttgtcccgcgaagccgaatgctgatgtaaagatggattgagccgccaattcaatgtccgcatcttcgtcaacgacaaccgtatctttaccgcccatttctgcaatgacgcgtttcagatgctgttggcccggctgcactttcgccgcgcgttcgaaaattctcgtaccgacttcacgtgatcctgtaaatgtgataaggcttgttttcggatggtcaacaagataatcgcctacttctgctccgcttcccggcacaaagttgactacgccttttggcaatccggactcttcaagcacctcaacaaattttgctgcaataacaggtgtagcactcgcaggttttagaaccactgtgtttccagtaacgatcggcgccactgttgttcctgccatgatcgcaaacaagaagttccacggcggaataacaactgtcactccagtcggcgtgtacacatattggtttttctcgccctcacggctgttgaccggtttgccttttgccagttcgatcatttggcgtgcataatactccatgaagtcaatcgcttcagccgtatctgcatcagcttcgttccaaggttttcccgcttccttgacgagcagggcggagaattcgtgctttctgcggcggactttggcagctgcgcggaacaaaacggccgctctttcttcaggggatgtgtatctccactcttcgaacgctttcgcagcagcttcaatcgcttgctcagcgtgctcctgggacgcctttgacacttttccgacgacttcttctttatcagccggattgattgaaacgattttcgcttccgtctctaccttttcaccgttgatgacgagcggataatcttttcccagatactcatttaccgtcgcaagcgctttcttaaattcttcaacgttcgattgatcttggaaattcgtgaatggttcgtgtttataaggtgtagtcattgtcatctctcccttttttacttcttagtcatccctttaaaggcgaatgcgatgtttgaggggcgttcggcgagccgtctcatgaaatagccgtaccagtcatccccgtaaggcaggtagactctcatgcggtatccttcttccaccaggctgagctgggtttgcgagcgcatgccgtacagcatctgaaactcaaaacggtcgtttggaatgccgtgctctttggcaagctgttttgtaaactcgatcattttgtcatcatgcgtggcaactgccgtataatgtccttttaaaagctgtttgcggatgagtcttttataattttcatcgacgtcgcttttttcaggataggccaccttttccgattctttataggcccctttgacaagccgcagaaacggattcagcgggctgaggtcgtcaagatccttctccgttctgtacagataggcctgcaccacggtgcttacatattcataccggctccggaagtctttaaagatatccagcgttttctggcatctcgtttcatcttccatgtcaatcgtcaccatgactttatgtttttcagccgtctggaggattttcgtcatattttcatagacgagatcgagatctatatcaagacctaaagacgtcatttttaatgacacttgggaattcagctgttcatcagcgattaaggcgatggtctgcatgcactcctcggtgcgttctttcgcgacatcaccgctgttgacaaattcccccaaatgatcgacagtaactgacagcccctggctgttcaaatgtcggattgtcgggatagaactgcggaaatccattcctccgatgattttgccggctgccacacggcttccccagcttcgcgccatcttattgagaaagctgctcttggataaaaataagaaaaaatctcttgtaatcacttccaaccttaacaccccgcaatctaagaagtatttgtatgagtctattgtaaatggacaaaacatcctctcacaatattctaaaaatacaaagattctgataaatttttgtggttttaccacaatcagcttcttagatagcaggcggattatgccgaaaaaaggcggacggaaatgacggcaatcgtcaatttccgcctttttccccccacgcctcttcgacggtctgaatcaatagccgattcagttcctccgttatgtcaggtttcggcgttttgatcgttttgacatagtgcccgatgcgttctatttcttcttctataaatgcatgaatgatcgtatttctgggttccggagccagctcctgaccgctttttttccttgtaagcagtgtattgatttcagaaatgagcgcttcatccgtcaataaggcatcggccagtacgggaaatgacatcggcggtacggagccgaacgtttcaatccatctgcaggcaaggagaggacgcagaacataaaaatactttttaatctttacttcactgccccgcaattccgttttttcattccgttttgccatattgagataatgatagatgccggcttcaggcgaaaaggcgcggattttcagttttcgaagcttttcagccgctgagaaagcttcataatagatcatctcagaagagagccattccaaaagaggcggatttgattttttaaaaagcctaagcgcttttctcagttcccagccgctgatgtcaagcatgtcatgaatcggctcttctatgacatccctatgcggttcgatcgaaaagtaccattcttttttcggcacatagagaaaccgcacatcgtagtcgctgtcgcttgacggaaacccccatgcgcggctccctgattctacggcgtaaagcaccttgacgccgtgctgtgcttcaattcgttttaattcttcgatgatcctttgtttcatctgtatccgtccttttccgtgatcattcctgaaaaaagcccaagtacttgggcttttcgctgtcgtcagcctttcagatgcgctttcagaaaggccagcttttccgtatggaaagaaggtatgtattcatgtccgaaataccggtaaaccttcaattctttttccgtttccagatgattgtacgcggcaaataccgtcgacggcggggtcacacggtcaatcagcccgatggacatgagcaccggaacttttacgcggtccgccagattcatgatatcaaaataggccagtgtattcatcgcggccttctccgtttcagggctgccgttctttctgaaaaaggagttaatctcaagatacggctcatcaagagcgacatcaatggcccgctcaaaattgcttaaataaggataatcggccgcaaccgctctcggaatgtcagatagtgccgccgcggcgattgaaagtccgcctccctggctcccgccgatgacggcgatcctcgtttcatcaacttcatcaaagccgctgatgacttccaaagcccggacggcgtctaagtacacgccgcggtaataatatgtatctttatctaaaatccctttcgtcatccagccgggaacgtgtccgtgcggtgagacgcttgtatctgtgctgctgtgctggccgcggacaagcatgccgaacgcggcatatccgtgaagcgcccaatttacgatgtcatgtatatccccgtcatagctcgcattatagccgtgatatttcacgatggccggatgcggtccttgccggtcgggaatggcgtaccatccctcaatttccgccttgccgaagcttcggtatgtcagccggaatactttcacgccgtcagccgggtagctttcagccgtcaattcaggctttgcctcttcctttgcaagctcatgtaatgatgatgcccaaaaatccgaaaagtcatgaggagcggttttatttggtttataggtttgcagttggtcgagcggcaagtcgtataattgcatatccgattattctcctttgttttataagatttaattttctgactctatcttaacacgattttacactcattttctaaacattttaataaacgtttgtttaaaaacaaaaaagccgtgcgctcacagcgtcacggctctttttacatcggctgatacaggtcccagccgatttttaacgtttctacgatataatcggcgatttcttctggttccagattatccgtcgccacttttgaattatgtttatcatagatgctttggcgctcgttaaagagctgctgcatttcatccatggaacggttatgcagaacgggacggctttcaatcagcagatcagcccgctgcttccaattctcccatgataaatcaagatggagcacgagacagttttcaagacagcactgtctgatttcctcttgtttaaacgaaccgcccccaagcgacacgatcttgaatttcgtattacggcaaatatctaatatataatccttttcggtctgacggaaaaaggcttcacccttctgctcaaacatttcagggatggacatattgaaatctttctcaatctgcaaatcaatatcaataaagtctctgtatagtttcttagcgaccagctggccgattgttgtctttccgacacccatgaatccgatcagtacgatatttctttctcttacgggaatggcacgttttgcgttcatcttcggcgaaatcctcctaagaaatgaaaaagttatgtttattatatgataactcaatattgaaatatagagataatgcaatgaaagaaaacccatcctttataagaagagatgagtttttctttctatcggagcttaatgcgttccacctttccgacaatgaaaatataagaaaatgccccgataaatgcgacagcgccgacaaacagaatcgctccgttataagaaccggtcgcagaaacgataaacccgatgataagcggggtgataataccggccatattggcgaaaaagctaaagacgccccctgccaatccgattgtttcgcttggcgcgacctcactcagcatcgtccaggatatgttggacatgccctgcgcaaaagaagcaatggataagatcgtcaaaaccgcgggagcagaatccgtaacattcgcaagcacgatggagcctgtcagcagaagaccgaggatgacgggcgttttccgggcaacgttcaccgacaccccccgtttcatcatgccgtcagaccaatacccgccgaacaatacgccgaaaaaggcggcgatatacggaattgatgcggcgaagccgacttttaagaaagccatgtgctttgcctccgccagataagtcggaaaccatgtcaaaaagaagaacagcgtggaggctacggcgaattggccgatatacaatccgacaagcttgcggtattttagaagctggacgaaatccgcccacgatatcctgccggctgaatcagacacctcagtcagtccgccgccttctttaatataatcaagctcctcacgattcactttccgatacccgttcggctcgtgatacattttaaaccagaaaatggagaaaacaattccgagcacccctgaggaaataaatacggcgcgccagtcaaatgccgttaacacccagaataaaaccggtgtggcgaacgccagcccgacatattcccccgccgtataaacacccgtcgcaaaggcgcgttcccgccttggaaaccatgtcgtgacaatccggttgtttgccggaaacgccggcgattcagctatgccgatgagcaggcggcagccgaatagaaacccgaaacttgtcgcaaaagcttgtactccggtaaaaaccgaccacacaaataaagaaattccgtatgtccgttttgacccgaatttatccaaaatgagcccgcctggaatctgcatccccgtataggtccagctaaacgcagaaaaaacgatgcccaaaagcgcggggcttatgttcagcgaatgttgaatggatgggccgacaatagatacactggctcggtctatataattaatcgcagtgataaaaaacaaaagaaccaatatcacataacgagcgcgagtcggtttattgcggacgggactgaaggccctcagctccgtttcttttttcaatggcttctccccccttactcgaatgaaattaattgtacaacacttcggttaattatttaatactttgacgcaaaaaagcgttaaacaatttgtgtgccgcactgacctgatgtagacacaccccgcttataaaaagtgtctgcccttttcacctgtttatccgtatcgcacccggggaaaaagtacacatatgataggcagttacgggaggattaccgatgaaactgagtttttgcacgacaggatttaagaaaaagcatatttttgacatcatttctttcgcgaaggagcactcctttgagggaatcgaactgtggtacggacacgctaaacaatatatagaggaaatcggcccgctcgacaggctttatcagcagcttcaggaggaaggcatcggggtgcctaccgtcagtttgtacactgacttcgccactcaggatgaaaggcaggcgttaaaggatgttcaaagggcattaagcgcggcacgacagctgcacagtcccttgatcagggtctttgccggcaatcttccttcgcaccggacgtcaccggaaaagtggcaacgtgcggttgatcaatttcagcaggcggcacggctcgcagatgactatgaagtcgatatcgggcttgagattcattacgatacgtacgcggatacaccggaggcggcgctggcatttttggaggatgtcggacatccgcgggtccgcaccatttttgacggctccaacctacacgtcaatcacgttgaccaaatgtccgctttggaaaaactgtatcataccgtcagccacattcatctgaaaaactatcactgggattttgacaactggtatctcagcaagccggtatccgttctgcaaggggatttaaggcaggaaccctttctgaaagaactgatgaacaggcaatacggcggattcgtatcactcgaatacttcggtcatcatgctgaagagcatatcaaagaatcactgaatgagatcaggcactgctttaagaaataaaaaacatcccctctgaagggatgttttttcaaattaagaaaaaaattttagaaatacagaagggattttatggataatcatctaattattaacactgtaacacatttcatttgaaaagggagtgctcgaaatgaaattcaaaaaagtgttaaccggttctgcgctgtctcttgccttactgatgtctgccgctcctgcctttgccgcatcaccaacagcatccgcatccgcggaaaatagcccaatctcaacgaaagcagatgccggcattaatgccatcaaactcgttcaaagccctaacggcaatttcgctgcttctttcgttttagatggaacaaaatggattttcaaaagcaaatactatgacagcagcaaagggtattgggtagggatttatgaaagtgtagataaataaaaatgaaataaacaaaaaacctccctttcaaaagggaggtttttttcattctatttccaccaatcatcaaacatcgatgccggcacctggcgcttatgctccgtactgagatagcgtttttccagcgcctcaatcacttcggaagaaacgtccttgccttctaaataatcatcaatgtcattgtatgtgatgccgagttcggtctcatcagtctgctgcggtttttcatcgagcagatcggccgtcggtaatttcaaatacaggcgttccggcgcgccgagctcttctaataaacgtctgccctggcgtttcgttaatccggtcagcggcagcagatcagctccgccgtcaccgtatttcgtgaagaaaccggtcaccgcctcggccgcatggtcggttccgatgacaagcagcccctcttgtccgccgatggcatattgagcgatcattctcattctggcctttacatttcctttgttaaagtcagacagctgatcgcccgtgtctttcttatactgatcagcgaacgcgctgacagcggacttaatatcaaatgtccatgatttatcaggtttaatgaatttgagcgccaattgggcgtcatcctcatcttgctgtgtgccgtgcggaaggcggacggcgataaattcagcgtttccgccttcttctctgatgctttcagccgccaattgggcgaggcgtcccgcaagcgtggaatcctgccccccgctgatgccgagcacaaagcctttggcacctgtttttttcaaatattgtttcagaaagttcactctgtcctcaatttcttgtttcggatcaattgagggctttacatggagatcattcataatttgtttctggatgctcatcccaatcactcctcctgcattgtttctttatgatccatttcccgttcatgctgaaaatgaatcatgccactatgtacgactctctgttaaatatagcacaggtgcagattttaagtgaatcaaatacaccgggatcagctgatttccacccgcagcgccgtgatgctgtctccgttgcattttcctttttcaatcggacaggatgaaaacgcgacgacgagatccatttccgcacggagccgtacataatcacccgcgtcagaaagaggcgtttcgactgataagttccccttctcatcgagcaccgtgttcataaagatggcaaatgggtaatgcatatgcggccgcggcaccccgaacggttcaagcgccccgctcatattgtcatagcacgtatcctggagctcgtctttatgctttccgtataaaagcctgttcatatccggacggcaggcgggaagcagcaggtcatgcttgccgactgtatcctcaatcagcgtcagcatcggcttgtataaattcgaataaatatgatcacccgtttttacatgaatggactggttggcatcaatcgtcgcgccctgatcaagatgttcatagaagtccttggcatgatacgccgtgaagtcagccacctgctgtccttccacatcgactacttttataatctgccctttgtgaaccttcaggccgagcccttttttcggcggtacaataaattgctgtgtcatcagactgctcctttttttcttctattatgaacttcggccgtttgtttcatgtaaagcaatttattggatgtatattccccttctgacggccgcaatctaagctttgataaaggggttgaacttcatgggtaaatcacaggaccagcctaaaggaaatctcgcttggtggcagctctccttaatcggcgtcggctgcacaatcgggacgggcttttttctcgggtccagcatcgctattgtcaaaagcggatattccgcgctgatctcatttcttattgccgggcttggcacctattttgtctttgagcagctcgcgaagctttcggccaaacagcccgaaaaggggtctttttgcgcttatgcgagaaaggctttcggcacttgggccggtttcagcaacggatgggtgtactggtcgtccgagatgctgatcacgggaagccagctgacagcgatctcgctgtttacgaagcattggtttccgaatgtgccgctgtggattttcgcctccatctatgcggtgctcggtcttttgattatatttacggggctgtccgtttttcaaaaaacggaaaatgtgctcgctgttgtcaagacagcggcgatttttatgtttatcgtgatcgccatattggcgctgtgcggtatattttctcataaaccggatgtgcaggtgccgaacgaatctaaggatttgttcccgcacggagcgatggggttatggacgggactgatttatgcgttttacgccttcggaggaattgaagtcttggggctgatgaccgtgcatttaaaaaagccggaggaagcctcaaaatcaggccggctgatgcttgccgttcttgcggtgatttacgtcatttctctcggcctggcgctgctgttagtgccgctgggcaaattcaccgaacaggacagcccgtttattacatcgctgaagggttttcatttagatatcattcttgatatttttaacgggatttttattattgcgggattttccacgctcgtcgcctcgctgtttgccgtgacgacattgctttgtacgatggccgatgacggggatgcgccgaaatgcttcagattaaaggaaaacaaaaaaatctgctggcctgcgctaggattgacgtttgccggactcatcgtctccatcatcctgtcattggtgctgccgaaaaatatatatgaacacatgacaaccgcggcgggcctgatgcttctttatacgtggctgttcattttgttctcgggcaagaaactgcttgaaacgacaaagatgggaaccgttcagattgttatcgcccttgtgctgattgtcgcggccgtctccgggacgctgtttgagaaatcgagccggcccggttttctggtcagcctttgttttctcgccgtcattgcgatcgtgacatggatcgtacaaaaaaagcagggacacagccctgccggatcatagcttatttcgtcggtttaaacagtctcttcaaataagaaaagggacactttgacacttgcgtctcatcatcacggaggaaatattgcttccattctaaattgtcttttcctccgtaccaccccaatcggggatgaagaggggcttcatcatacgcctctaagcgttttctgatcagccggctcatgtttcgtccgaacgcggttgaatcatttaatccttcgaaaacccatctcggctgaaacgccagcataaaaaacgggaagcttctgctttgtctcgcttcatgcgcaggcgtcgcgcatagaataaaatacggctcgccgtcaaagcagaactcccatttataatgttcagggtcctccggtatgtcttccggccagtctttcgggtcgcagccgctcagccggtttaaaaaagaccagaacagttcttcatacgcctcaacggaataatgctcagctaaatcctcaggcgtatcaaaaatcacaagcagcgacgcgtattttccggtattccttgagatctttccgtactcggacagcagcatccccacttcctccggggttccctcttcgcggggatcacccgcaaaggatatccggagctgatctgtcaaaaatccctgacgtcccggaatgcacggaaacgcgtccgctttatcacctactttttctgatagaagctcaaaagcgactctctgccaatttggcagatccaacaacttttcctcaaggcaactttttgtgtacagctcgcttgccatcagcccacctccagtatcgtcaggatacgttatgatggagacaggcgatgggtgacagtccttctatttatgagatgagcatttgaatcccctgccagccgaaataaaatccgaaaacgatcaaagacacacccgccgctcccgtcagccagcggagcgctttttcatgaaggagatttctgaaagtgctcgcggcgaccgccatgcagaaatcccagatcaaaatgccgagaagaatgccggagctgtaaatcaaaagctgatttgtatcgaaggattcagcggttttagcgaggatgctgccgtatatgccgagccagaataaaatgctcagcggattggaaagagaaataaaaaatcccgcgccgaatgttttgtaaaaagccggttttccttttccgcttctgacattcatggcttcccttatattttttagcgtttcgactcccgtataggtcagcacgaaaaaaccgaagagccacaaaaacgtttttacaaaaggagcggtcaaaaattgagacagcccgaaatagatcagaatcatatacagcccgtccgcggccatggcgccaagaccgaaaatccatgcatgccaaaagccgtttttgatgcctttgtcaatttgcgccgcattgaccggtccgacaggtgctgacaatgacagcccgagaacgatgtagcttaaaaagatgttcattggcttccccctcattcatgcaacttgtacaagttattcatgaatgggccgtgctatgatatattattttaatttctcaagctcgtcttccatcatgtccgtcgcttttcctaaaaaatcgaatatcagccgcagttcttcttctttatattgccggcaaaggctgatcgtagactgggataaggagctgaacaattgcttcacattcgcttttccggctgtcagcggcacgataatcacccgacgtttgtcttcggggtcttttttcctcatgacatatcccgctttttcgagccggtcaatgagcgccgttaccgaacctgtgctgagaccggtttttttcccaagctcgcctgcggtcatcgggcctgcttcatttaagatatcagctgattttaaatcggtcggaaacagaccgagagattgagcggccgcctgatgaaaaaggatcgtccttgtggccatctttcggaataactgtatcgcggtttcctccgtctcgcttctggtatttcttgttgacaactgacaggcctccctataaaatcaatttatcttgacgatcaagataattttcggcaaatctaatatgatcatagcaaatttaatgatcaaaagtaagtatgggaggaaaaagcatggaacaaacagccgcgaaggacgcctcgacgaagtttgtcgtcatcggtcttttgctgggcattttaatgtcggctatggataatacaatcgttgccactgcgatgggaaatatcgtggcggacctcggaagtttcgataagttcgcgtgggtgacagcatcatacatggtagccgttatggccggtatgccgatttacggaaaactgtccgatatgtacggacgcaaacgtttctttttattcggtcttattcttttcttaatcggatccgcgttatgcggaatcgcccaaacaatggatcagctcattatttaccgcgtcattcagggaatcggcggaggcgcgctgatgccgatcgccttcacgatcatttttgatttatttccgccggaaaaacgcggaaaaatgtcgggcatgttcggtgcggttttcggcctgtccagcgttctcgggccgcttttaggcgcgctcattaccgactccatcagctggcactgggtgttctacatcaacgtgccgatcggtattttatcattgtttttcattcttcgttattataaagaatcccttgaacacaagaagcagaaaatcgactgggccggcgcgattacgctggtggtttccattgtcggtctgatgttcgctcttgagctcggcggaaaaacgtatgattggaactccgtgcagatcatcggtctgttcgctgtgttcgccgtgttctttatcgccttttttattgtggaaagaaaagcggaagaaccgattatctcattttggatgtttaaaaaccgtttatttgctacggcacagattctggcgttcctttacggagccacgttcgtcattttagcggtgtttatcccgatcttcgttcaggctgtgtacggaagcaccgcgacaagcgcgggctttattttgacgccgatgatgatcggctctgttatcggaagtatgatcggcggaattttccagacaaaagtgcggttccgcactttaatgctgatttccgtggtcgctttctttatcggaatgctgctgctttccaatatgacaccggatacggcgcgtacgatgctgacggtattcatgctgatctcaggattcggcgtcggcttcaacttctcactgctgccggctgcgtccatgaacgatctggagccgcgttaccgcggaagcgccaactcaacaaactcgtttttgagatcattcggtatgacgctcggtgtgacgattttcggaaccatccagacgaatgtgtttaccaacaacctcacagattcattcagcggcatgaaaggagcgggcggtgcgatgcagaacatcggaaatccgcaggagattttccaggccggcacgcgcgcccatattccgccgcacattctggatcgcattattgacgccatgtcgcaaagcatcacatatgtatttacgcttgcgctggcgccgatcgtcattgcggccgttaccattttgtttatgggaaaagcgagagtaaaaacctctcaggaaatggcgaaaaaagcgaattaaaaaaagcagtacatggcgtttgtcatgtactgcttttttgtttactctgcgaaatgcggagcgagaatatctttcagcacgtttgcgctgcggctgaattgagcctgttctgtttcattcagctcaagttccgtcacacctgcgatgccgttccgattgacgacggccggaacgccgataaagacgtcgtttacaccgtattggccgtccagatatgtgctgacggttaaaatgctgttttcattacgcaaaatcgcttttgtgatgcgggcgaggctcatcgccactccgtaatatgtcgcgccttttttctcgataatatggtaggccgcgtttttcacatcgtcaacgatctgatccagctcgtcctgtttgtaagctgcatttttctccagcaattgctgcaccggcactccgccaatattggcgtgactccatacaggaagctcggtatcgccgtgctcgccgataatgtgggcgtgtacgttttgcggagcggctccgaagtattcgctcagcatataacggaatcgcgcagaatccagtgtcgtgccgcttccgatgacgcgttctttcggcagcccgctgaatgtccatgtcgcataagtgagaatgtcgaccgggtttgtggcaacgaggaagatgccgtcaaatccgcttgccattacttcaccgacaatgcttttaaaaatggcgagatttttttcgaccagctcaagtctcgtttcgcccggtttttgattggctccggcacagatgcacacgatatcggcatccttgcaatcctcatatgtgccgtaagatgttttgaccggatgaggcgcaaatgcctttccgtgatttaaatccatgacatctcccatggctttttctctatttacatcaatgatcacaagctcatctgtgatcccttggttaattaacgcaaatgcataactgcttccaacaaaacctgctccgattaatgctactttgttcactcgttcgttcatcatatatgctcatcctccagtgtttcgtggtgtctgtttttatcttgtgaagtatttcacatttatattgtgcaatacttcacaaacttttgcaagagaaaagtttgatttttggacaaaaaaatatcggtgatggtttccggattgttgacaacatcctaaaacggaaccgttttaggatgctgtcatcttttcagcgtgattgaaaacgcgctgtccttttcctaaccgaagtaagggtttgatgtgatgatggccctatccattaatgcggaagataaccgtttaaaccggagttgttatacaaaccattctgcacataatcaaagccgggctggttctgtccgggcacttgggcgctgccattgttaaaaatcactttggcattggccgtatccgcattcgcaggcagcgtcagcgtgtaaattccatttgcattcttagtcattgctttcccgggccacgatccggttaattctatggccctgcctccatcatgtttgtaaatatatacatttacctggccccaatgatccggattttgatagccaatgatgttggtttgggccgggtcttttttgacaaacgtgtattcttgggttctcgctgcaccctcgacgttcgttccggttaacttgatgttgtatgtcgtgccgattggatctcctttcccgatcgttaatcggtccccatccttaaatgctgtctgctgcccattattgatttggtaaacggcttttgttgttttcgcatttgcacgcagggtgaccgtcagctgatcattgaaagaatggactgcccccgtttggtaattctcaagaaagacatgaggcgcattcccaatatcatcaggataaagaacagccgccgatctggcattgatcgtacctgtcagtttgccgttcgctacttgaaatgaaccggcgccggccctattatcatacctgccgtcaggtaatttcgttgaagtattgatggtgacagaagacgatcctgcatttgccagcacaacgccttttgagccgcgctgattcataaagatttggttgttcccattcggattcgagagttcctcaggctgcccggccattacattgtgaaattgattgaccgcagtgatcgcctgatctttaaataaggcgctcccgcgatctcctatttgactttttccgggaaatcttacaccatttcctccgccctcaggtctggaaaagaaaagaggcgtgcttcctgagcgggaaccaatcactgcccagcctaaacgaatatcgtcatcactcatccatgtggactcttcatcatcattggcatacgtatcatgtgattccacccatgtgactaacttgtccgcagacacgtcagatgcataatgggagatattcgacacactcagattacggttctttaaagcggatctgatggaatgcccgtagttagaagccgtcacattcatataattcgcataagcagtatctctggacgcgctgtcttgcaggatttctccgtattggaactctgccgatatatttgtgatattcggccaaaattggctgccgtaattcccatcatccggaagctctatatgcttggcggcatcatagcggaatccgtctgctccgtcattcaatgctctttccaagaaacgtttcagatagacctgcacctcagtattctgtgtattccaatcatacagcccaagcaatgaattttgagtgacgtcccatcgatccgaccaatttttaatttgtgtgtttccatgggtccagtttgaaatacgcttaatctcgtcagaaatcgcggcataatcgctggtggtatgattgataaccgcatcaacaatgacttttacgccatatttttccgcggctgcacacatgtccttaaattcttgttcagtgcctaagtaacggttgccgatttggtacgatgtcggctgatacagccagtaccagttcctcatgcttttatctccttggttcccttcctttacttggttaatcggagacgtctgaatggctgcatagcccgcatcacgaatctctttcatattttgtgttaacgtattgaacgaccaattccatgcgtgaaggatggtcccgtttttgaccgatgacgcggccacctcattcgatttgtttgcagtttcagcgtttgcagccgccgggcctgacaaaaccaaatgaaacagcaataaaaatccggcgaataacggcagtaaagaggttttgaatcgtttttcaaacatttttgacactccttatttgatttttgaagactgactgcggagtcaaaaattcctcttactctttcttcagctcctttcaactgttgtgaagactggagaattttgttaacgcttacatttcaacttatcacactctctctatcaaagcaacgtgacagagtgaattcaaatctatattcctatcaattaaaaagacttcccgctttcaaacaaaaaaagaaaccacctgtcaagatgatttcttttttatttcttttatcgctcttctgtaagacagcttcacaatgacataccgaagcagaaacagaatgcctccgcagacgataaaaagaaagatcattttcagccaagcaaagaatgtatggggaacccccctgtcgtacatcgtaatcgccgctgccgcaaaagtgaccgcaattgaatctatccgctgctgcttcacccgcttttgcagttcttctttcgtgtctattctcggcatgagcattcccgacgctcccgccctgatgcaataataaacaattataatgaagaaaaccgccaagcttccggcccattccctaaacggacagttcagaacaagtccgcgtacgatgatgtcaagcaaagacagtgtgcccacaagcattccgacttctgaccaaatcattcgttctttctctttcacactctcactctttccattcacgtttgaaagtccgttccgacgctgattcatgacttcctcccgtactattaagaatggcttacaactcccattatatcttgccgattcataatgataaaccgaaatatcattgacaaaatgtttaataaggaccccaattgatcaggacgcctatgcagataaacacgaggccgatgacaaaccaaatcagcgccagcggaatcatgaagcgaagccactttacgtacggaatgccgctggcagccagtacggccatcagcacgccggaagtcggattgacacagtttacgacgccttctccgagcatgaccgcttcaaccgcgacctgtctcgtgatgcccatcagatcggcaagcggcgccaagatcggaataaatacgaccgcctcccctgagcccgatgaaatcagaaaatgaagcagggcgctggaaatatacattccgattgcgcctgccatcgggctgaaaccgtgcagcagtgacgctagtccattgactaccgtatcaagcagctttccatgttccaggataacggaaatgcttctcgccattccgacgatcagcgcaccgtaaacgagcccctgacagcctgtaataaacgtttttgcgacatcatttgccgccattcccgcaatcaggcctgacacgattgagataaaaatgaacacggcggccatctctgaatcagaccagccaagagtaagcgcgccgtataaaaagccggcaagcgacaaagccgcaacagccagaatcaatttatggcggacggtaaacgggacatgcttgtcctccggctcagaaacctgcgggagtgaacctgccgccggaaaccaatcgttccccagcagactggcgtcctttgcttttctgagttttctcgtataccgataaatatataaaatagatgataacagaaaacaaatgtagacggcaatccgcaggccgataccggaaaacagcggcagctccgcgatgctttgtgataacccgagcggtgaaggtgataaaatcgtcgcgttaaacccggcatagcagccgatataaataacggccgctccggccacggcgtcccatttcagcgagcgggcgacgatcaggccgatcggaataaaaccgatcacggaattaacgacgatgccggttgtgccgaggatcgaaaatagagatccgacaatcgcaataaacagcagctgttttgtgcggaacgtactgatgacattactgatcaatccattgatggcgcccgttttctccaaaatcgcaatggtgccgcccgtaaacaggattaaaaaaataatcggcgcggaacttgtcatcccttcctgaatcgcggtaaaaaaagcgatcgggctgacaggagactggtctaaagaatgatagcttcccgggacggcggacgacacactgccctttgtcaccctgtcaaattcccccgcgggaacgatgtacgacgctatcgcgcatagtaaagcgacaatgaacagcagcacataagcatcaggcatcacaaacaatttcttctttttcaatacaggttcggccttcggcacagccataacatcaccatcccgctttaaatttataaactattcagaaaatacagatatgtgctatattatatacagaccgattgcctgttttcaatatcaaaaataaaaaacagacagcttttgaaggaggacttacggcatgaacagactcacagcgcatgaaaagcaagtcattatggatatttttgaccacctgcacgccaatcccgaagtaagctggaaagaatatcaaacaactgaatatctgactgaaaaactgaaagaggccggctgccgaacccgcacgtttgatgattgtaccggtgttgtcggcgaaatcggagaaggctcgcccgttgtggctgtccgggcggatattgacgcgctgtggcaggaagtggacggtgtctttcaggcgaaccattcatgcggacatgattcacatatgacgatggcgctcggcacgatgatgcttttaaagagtcagccgaaacttccgaagggcaccatccgctttatttttcagccggctgaagaaaaaggcggcggagcgctgaaaatgattgaaaaaggcgtactggatgatgttgacttcttatacggcgtgcacgtgcgccccgtacaggaaacggcaaacggccgatgcgcaccgtccattctgcatggctcaagccagcatatagaaggcctgattatcggagaagaagcccacggcgcgagaccgcatctcgggcttaacagtatcgaaatctccgctcttctcgtccaaaaactcagcttcattcatcttgatcccggcatcccgcattccgtgaagatgacaaagcttcaggcaggcggtgagagttccaatatcattccgggaaaagcatcgttcagccttgacctccgcgcacaaacaaatgccgccatggagaaattaaccgccgaaaccgaaagagcctgtgaggcggcgactgccgcattcggcgcaaaaattgaattacaaaaagaacacagcctcccggcagccgagcgaaacaaagaggcggaagccatcatggcatctgcgatcagcggcattctcggagaagaacatgtggatgaacctcttgtgacaaccggaggagaggattttcacttttacgggttaaaggtgccgaacttgaaaacgacgatgctaggcctaggatgcggtctggagccgggacttcaccatccccaaatgacatttgaccgaagcgccatctttactggcgttgagatattaacggccgccgtcctcaaatcgtttgaagcataagaaaagcagcccgttacagggctgcttttcttcgttatttcttcaaatcttcaattgaattgacgtttttcatatactgaggaacgaccagacccatcttgacgcctgtcagactcgttcctacatcttcatatttgcctttatatttagacgcatatgccttatgggtattcggaagccaagcagacaatgacgcatccgcgctgcctgtcgcaatcgcagtccacatcggtcctgcctccacttgcgtcagcttcacgtcatagccgaggtcttgaaatacttttccgattacattcgtacttgcgatttcactgtcccatgccacataagccaggttaattttatcccctttaactttatgggcgccttttgtccattgagccacttggtctttgtgttttttcacatattcagcagcggctttggccggcttttcgccttcttcaacggcaatcatgacttctcccatatcgtcctgcgtccatttgaactggctgagaactttggccgcgttaggctgttccttactgaagccggttcttgtaattgtatgaatctgctcggcagttccgtacgtttttttcggatcatcaaggaacttcagcttgtatctggagaacatccagtgcggcgtccagcccgttacgatgatcggctttttccggtcatatgatttcttcaatgtcgccgtcatggcggcacttgacgccgtgacgacattccagtctttcaatccgtaatccttcacggcctcatccgtcagggccatgatccccgatcccggatcaataccgataatggttttgttcacctggtccgcagccgttgccttaccatcagtctgcgaaccgcaggcagccaaagaaagagccagcgcagcggtaacgccgacaccgatgattttcttaagcatcaggcattccccctgctcttcttcttcactttaatgttttgcgtgatacggtcgagtgtaatcgctacgataacgatcgcgataccagcttccactccgacaccggttttcaactgtgtcacggcgctgtatacttcagaaccgagacccggcgcaccgaccatggccgcgataacgaccattgacaaagcaagcatgatgctttggttaataccggcaagaattgtttttgtggcaagcggaagctgcaccttgaacagacgctgagacgtcgttgaaccgaatgcttccgtcgcttcgatcaaatcagccggaacttgtttaataccgagaaccgtcatgcggatcgtcggaggcatcgcgaaaataacagatgccacgacgcctggcacaaccccgatattaaagaagaaaattgcaggcagcagatatacgaaagccggcatggtctgcattaaatccagaatcggtgtaacaatgcggcggaccgtttctttctgagacgcccatatgccgatcggaaccccgataataatggaaatcaaaacagatgtgacgacaagcgccaacgtttgcagcatcggcgaccaatagcccaaataatcaataacaaggaatccgattaacgtaaagagtgcaattcctctcgtactgatccaccaagcgagagctgcaaaaataacagtcaataaaatagacgggatgaaacccaaaccgctcacaatcgcgtttacgaaagcggccaaaccgtttgagattccgtcaaagaaacccccgaacgtcatggtaagccagtcaacaaaccggtcaacgatatctgctaacggaattctaggcaatctgtccatttacttcaccccctgaacagaagaatcctgagcttgttcagcagaatcttcaacatttatataatcgttatttcctgaaagcgcgccgattaatgcgccttttacgacaatgcctttcatgcggtccttatcatccgtgacggcgatcggaatattcgcatcagacacgacatcgaaaatttccgtcaagtatgtgctttcatgcacagtcgtaaattcagtatttaaaatatcctgaagcgataagtcggattccaccgcttttttcgcatccgccgcgtgaatgacgccgagaagctgtttctgtttatcaacggcgtaaatagaagaaataccgagattcttcatgagctgcagcgctacacgaggccctttgtcaatccgcacggtttcagcgcgcttcatgatgtggcccgctgtcagaactttggataaatcaacgtcctcaacgaatttctcaacgtattcattggacgggctcatcagaatttcttcaggcgtcccgatctgaacgatgttaccatctttcatcagcacgattctgtcgccgatgcgcaatgcttcatcaagatcatgcgtgataaagatgatcgtcttgccgacagagtcatgaaggtctaaaagctcatcctgcatgtctttgcggatcagcggatcaagcgcactgaaagcttcatccatcagaagaatgtcaggatcattcgtcaatgcgcgcgcaagtccgacacgctgctgcattcctccgctgagctgatcagggaattggtgttcaaagccttcaagaccgacaagtttaagcgaatcaagcgctttttgctcacgctcttttttgtcgacgccttggagctccaaaccgtattccgtattttcaagaatcgttctgtgcggaaacagtgcaaatttttgaaagaccatgctgatttttttccggcgcacttcccggagctggtcttttgacatatttgttatcatgtcaccatcaatataaatattcccggcagtcggttcaataagccggtttaacagccgaactaaagttgatttaccgctccccgatagacccatgatgacaaatatctccccatcatatacatcaaagtttgcttgattgacaccaacggttgatccggttgctttcaggatctcttttttgttttttccgctggacagcatctgaatggctttttttgtctgttttccgaaaaccttagatacattttcgacttttatcttaattggtttctcatccaaattcatattttccctccataataagcaatctttaataccgtaacacgtttgtaataagtcaaacaaacatcataatcccgtttattttgtatcattactttaaaaacatccctgtgtcttattttcctctggtatgcttctaaatactctctaatcctccttattgaggataaattataaaggaaaccgggcttttatcaggcttgagaacgtttccatcgaatgtgctgcaaactgatttcctatcctttttttacaaaaacaagaatttttttgcgacattgtcccggaaaaagaagttttcgcctcctgaaaataaggaatattaaggaaaaatataggtctgccaacagacagctcactaaaaaaagcaccccaaaagggtgctcattgcgcaagctctgtctgtttcgtttcttttccgagaataataatggtgatgacggcaatcaggatggccgcacaaaagacggcgaaaatcactgtaaacgaaacgttccgggctgcaagcgatccgacgagaagcggaccgaaaatgccgccgattctgccgacggccgccgttgtgccggaaccggtcgcacgaatcaccgcaggatactgctccggtgtataggcgtaaagcacgccccatgcgccgagattgaagaaggacagcagcatgcccgctgtgagcagcatggccaatgaatccgcggcaccgaagaaataagcgctgcccgccgttccgagcaaatagatgactaagatggtcttccgccccgctttttcgatcagccacgccgcagagaaatatccgggaagctgggcaagtgtcatcagaaggacgtattcgaagctctcaatcatgctgtagcctttcatcagcatcacgctcggcagccataaaaacatgccgtaatatgaaaagacgacgcagaaccaaacgacagacagcagcaccgtcggccggatatacggtttcgtccagacacttcccgcctgcccgcgtatgctttttttctgcggcaatgcctgatgcgccggtgattccggaaggcttctccgcaagtacagcgcataaaatgcggccagcgccgttaagagcagcgcggcctgccagccgaatgacggtatgacaaagtaggaaatcaccgccgcaagaagccagcccgcggcccaaaagctctcaagcagcacgatgatccgtccccgcttttcgggagcggacgcttctgacacgagcgtcgaggcgacaggcagttccccgcccagccccattccgatcagaaaacgcaatatgagaaaaaccgtcaatcccgttgcgaaagcggatatgccgcttccgacagaaaagaataacagcgtgatcataaacacttttttccggccgatcctgtcggccagcattccgaatacaaaggcgcccgctgccataccgatggaattgacgcttccgatccatttcatttgatcgggtgttaaattccaatcagtgtgaagcgcggcgataataaacgataaaattccgacatccatcgcatcaaacagccagcccattccggcaatcgccagaagttttcgcggagtgacggcaggttgtttattcataagcagcacctcaaatcgaaaatgattaccgtataagtttacacctgtctttacacattgtcattatcttttttcgcaaaaaatcccgcttgccgtaagcaagcggggtgtgtgttaattctttaagactgcgtttttaatattatcctgaagctgttgaatccgtttcgcgccgtcttctctgatacgtctgttctcttcctcgatctgtttcgtttcctgcataccgctgacaatcgtattccaagacgtttcaatcgtctcaatgtcaatgctcggacggcctgccatacgggcaatctccacgctttggtttgaaatattttcagcgtttcgcttcagcatttcattcgtgcggcggtccagctcgctcattgaatcagccacaagcttttgccgtttgactgtgacagcctgaatgatgccgtttttgaaaatcggaatcgtaatgacgaaagcggaattgattttcccgatgagcttcgtatttccgcgctgaaggaggcggatctgcggcgccgtttgcagcgccaccatccgcgccatatctaaatcatagacacgttcctcaagcgcctgaagcccgtcacgcagcgtatcaagctgcatttgcgcaagctggtttccgccggccgctttttcttcataagaaggaatgagcgcctgcatttcctcaagcttcatctgcccggcaacgacatacttttcaagctccatgtagtagttaatgttgttttcatacatctcttcaagcgtatggttcgtctttgccatttcatctttgtattttgaaatttcgacgtggattttttcaatttctccgcccagggtgcggtacttttgaaaaatcttttcaatcatgctgttgcctcgtttgaacattttagcgagaaatccttttggttcatcgaaatcatttttgtcaaaacggtccatgatttttccgagctgcgtcagcattgtgcctgaatccgtgacacttgttgttttcatcatatttaagatgcggtcggagaacttcgagatttcaactgccggttcttttccgtactcaagcagctccatttggtttttcacgtcaatctgctgtgaaatgcgctgcacctcaggatcttggcgcagctgcaccctgatgtcatctgctttttgttcagaaatctcttcatttttatcaagaacaagcggattttgattttctgtcatgttttatttactctccctgcttttgcgtaatggttctaaacagctttcttacgagtgacggctccttatattcctgccgaaataccatgtcctccagccaatggacatcaaattggctttcttcaatataatgctcaatgtcctgatggcccggcggattatacaagatgatatcgacgccgaatttatttaaaaacaatagagcggcggcgtcagaacgtgtaagttcgccattttgttccgtatgatataaaacgagtttcggaacggtttgggcgtaatcaaacgtctgaatcaattgcagcagcgaagcgggcaggttcgtcgcctggcggaacaaatagattgcggcatcccttgcctgctccccgggcaaagccttcagccctgggtttctgcacatgtcagaaatcacattggcgatggcgttctgcacgcctgacgggagatgcttgtactgccagatgttgcttcttttcagcctgtccgcgtcaatcgctccttcttcgttcaaaacctgactgtagtgatactggtagttggctttcagctcttccgtaaacggaaaactgcggatcatgtgtgtctcctgatagtctgcggcggtatggagtctgttccaatattctttcgtatctttggaaacccccatcactttcgcaaaaaggttcggaacggccacccgctccctgtccgctttaaattgcggccggataaacgcccgctccttcgcaatgagaaataactcatcatacgtcgtttttaatgtcacggactgcggggtatgatccctgaactgccaaggcttatacatcatagattcctcatggttcagcacatgctcaatttctttcgttgaccggtaggccgtcgtggacgttctgtccggcttttctttcgggaatggctcaaggccgcctgttgcggggagctttatcacaaagctgagttcctcatccggatcaatcaagctgaacgggtcttccgcagtcggatgaaacaataggacgtcacagccgatcagcatgagataatagagaaaatagagctggcttttggcagcgtctccataccacaccaccttcggcatctcacgctctatatcggcttgttcgagccatggattcaggtggttcagcgaaaactttgacacatccaagagcacacgccggaaatcgggatgattcagcccgttttcatgccggtccgcaaaggtttccaaaagcgtcataaacgcggttctcagccggcggtgcataagcggatcagcgtgtttggcaagcagcctgcccccatcgagaaacgcgacaaatctggaaaccgaaagccctttctctttttgattgaccgaatggatgtgctggagcgcctgaaacgtttccggcgcgatggtcttatccagcgtctcgcttaacacatggatgttttcatgagaagacagctcgaaaagcttattgtaatactccgtctcatcataaggagtacccaaaatccggacggcaagacgggtaaacgccagcccgttttcccgctcgtaaccgggacgttccggcagcggccgcatcagaaacgtttcccagtcatcgttttccggctcggcctttcggatcaccaattcttcctgcctcatcattttcctcctttctcttcatgatgatcggtacaaaaaaggaaggaaatgaactctccctccttttttgttttattcttctttagatgcagccgtttgctcctgaacctgcttttgtttgttgaaatagtggataataaacgttaccacaaacgcagcgatgatgattccgaagaacaccacgtgcggcatttcataatcaaaggcgctcgccgccattttcacggcgataatcccgatcagcacaaaagccgtattttcaagctcagggattttatcaattaaaacaaggaatacttttgcgactgtacgcatcatgagaatgccaagcataccgccgatcaagagcacccacactttttccgataccgcaaacgcggccagaatgctgtcaacagagaaggccaaatccattaactcaactgaaacgacagtggcccagaaaattccgaacgtacggaccatccatgaatttttcttcatgccttccgtatcgtcatcaccttctccgatccagaaatgcttaatgacgagccaagccaggtacagcgcgccaagcactttaatccaccagaacttaatgagcagcattccgatcccgataaagataaaacggaaaatatatgccccgaacaatccgtatgttaatgctttcttccgctgtttttcaggcagatgccttaccatcaccgcaagcactaacgcattgtcggccgacagcagcccttccagcagaaccaaggaaccgatcagcccccatgatacagggtcagtcagcacctcaccccacattttccaatcaaaaaaggaagcgtaggtcgacataatatgatgtagaaaatccaagttttttcctcctatttagtaaaacggtaatttcctgcttacacctgcaagccgtaattccggcaaagtgatgccagaccgccggaaaacccgctgccgatggcgttaaacttccactcagccccatggcggtaaagctcacaaacgacaaccgccgtttcaatcgagaagtcttcccctaaatcgaaacgaagcagttcattctggctgttttcatcgacgacgcgcacgaacgcgttcgaaacttgtccgaaattttggccgcgcgcttccgcatcatgaatcgtgacggtgatgccgatcttttcaatatttgcgggtatttttgagaagtcgacgataatttgttcatcgtctccctcgccctcgcccgtccggttgtctcccgtatggatgacgcccccgcttgggtgttccaggttattgtagaaaacaaaatcaagatcatttacacagttgtcatgggcatcgacaagaaaagccgacgcgtcaaggtcaaagtcatgccctccggagtacttgttcgtatcccagcctaagccgatcaccgcttttgtaaggccagggttcgtttttgtcagatcaacacgctgtcctttcgccaattgaatagccatgtgccgtctctcccttctgtgtgtgatatggttcagccgatttgcaggccgtaatctgtcgcaatacgggccagtccgccttggtagcctgagccgatcgcggaaaatttccattcgccgttatgtctgtaaagctcccctgcgataatggctgtttcaattgagaaatcttcagccagatcatagcggatcagctcctcatttgtctcttcattgacaatgcgcacgaacgcgttggaaacttgtccgaagttttggccgcgcgcttccgcttcatgaatcgtgatgacgaatgaaattttgtcaatagccgcgggcaccgcgctcaggttgactcttacgctttcgtcatcgccctcgccctggcctgtcaggttgtcgcctgaatgtgcgacagagccgtttccgccttcaagctgattatagaaaatgaaatcatcgggcgacgcgcatcttcctgcttcatttaatagaaagacgctggaatctaaatcaaaatcatgtccgccgtcgtatttgtttgtatcccagccaaggccgacaacgactttagaaagacccggatttgttttagtcaaatctactttttgtccttttgccaatgaaattgccatgtgtgcactctcctttttatcgtttaggcgtatcggttaacgatatcgccgatttttgtatcgtttgtgccttctcctactgcggcgaatttccactcgccgtcctggcggtagatttcagccgcgatcaggctcgttctgcctgaatagttatctcttaaattgtaagtcaccagttcttcgcgattagcctgatcaacgacgcgaatgaacgcgttttgaatcatgccgaagtcctgttttcgtctgacgcagtcgtaaatattgacgacaaacacaagtttattaatctgagcgggcactttcgccaaatcgatgaggatttgttcatcatcgccgtcgccttcacccgtcaggttgtcacccgtatgtacgacaccgccgcaccggcttttcaaattgccgaaatagatgacgtttttgctgtctgtcattttatcattttcaagcatcagtacggaagcgtcacagtcgatattggcaccgcctccgccgaacagctttccgaaaaagcccccggatgatacagggtcccagccgagtccgaccagcagttttgacaggccggcttttccttttgttaaatcaatccgctgtcctttttgtaaagagatcgccatatgattcactcctattctgtaagggtgccgctaagcacgccgcaagtgcgcatttttactaaattccgggacaagaatcccggtgtttattaagatatacgtcttttattatatcaaagtttcataaaacataagaatttttggcgaaaaacggcgaaaaattacttcctatattctccttcgttccggagaaaatagagaaaacaaagaaattgacgaagactgaacatttttcctatccttgtatcaatacatgtcaggaaaggggcagacgagtgattgatttaagcatacttgatcaggcgcccgtatccaaaggaaacgggccgcacgagacgctccgccgttcagcggagctcgcccgcctcagtgaaggatggggctataagcggtactggtttgccgagcatcacggcacaagagggctcgcaagcgtttcgccggaaattatgatcgctcataccgccgcagccacaacgtccatccgtgtcggatcaggcggcgtgctgctgccgcagtacagcccctataaagtcgcggaaactttccgtcagcttgaggcgctgcacccgaaccggattgaccttggggtcggacgctcaccgggcggcacgacgaaaatccggctcgccctcacagacggggtaaagaaaagcatgaccgagtttaacaggcagcttcaggatttatcatcctttctgacagattcggttccctcggaccatgcttatgcaggaataaaaacagcgcctttgattgaaacagccccgcagctttgggtgctcggcctcggggaaaacagcgccagacgcgccgctcttcaaggtgcgggctatgtcttcggccatttcattaatccggaacgcggggaaaaagcttttcagatctatcgggaccatttccgggcctccgcccatttttccgctcccgcctcgctctgtgccattttcgtcatatgcgcggctacggatgagaaagcggaagaactcgccttaagccaggatttatggcttcttcgtgtcggaaaaggcgccgacagccgcgtgccgagtgtggaagaagcgaaggcttatccatattcgccggaggatcgtaaacagatagaagaaaaccggaagcggatggtgatcggctctcctgccgcagtgaaacgccgtctgcttgaactttctgcgcggtatcagacaaaagagatgatggtgctgtgcaacgtctttgatttcgaagcaaaaaaagagtcatatgagcgtcttgctgatatatttctgtaaaaaaagccgtcaaacggagcagcagatgagactgctgcaccgcttaacggcggttttttcgttcttttccttttttaaacgcattccaaatcccttgcagcgtaaacccgagcagaagcagaatgattaacagtaaagtgattgacggccccggaggcgttccgagctggtacgaagacgtcagccccatgaacacactgaaaagagaaataataatggctgccgcaaacacccatttaaaccctttggcgatacggattgcaaaagccgcgggcagtacgaggagcgcggaaacgagcagcacgccgataatcggaataatgaccgaaatcgccagccccgtcacgatgctgaatgacattgacagcaggtttgtgttaatgcctgatgtcttcgccgtcgcctcgtcaaaggtaagcagatagagcggtctgtttaatataatgaaataaagcagaatcagcagggtaatgcctccgataatatagacctgctgctggctgaccgtgacaagcgatccaaataaatattgatcgatgctcatcgacgcgccgccttttgacaggctgatcagaaacatcgcaaacgacagcccggccgccattaagattgcgatagatacctcggaatatgtacggtacgcccgccgcatgtattcaatgccgatcgctccgatcgtgacgacaacgatgctcgccgccgtaatattggtactgagaaaaaaaccgatggccacgcccgacaatgaaatatgagacagcgtatccgccatcagcgcctgtcttctcagcacgagatatacgcctaatatcggcgccataattccgatcatgcttcccgctagaaaagctcgtcgcatgaattccaagtcaaacatttccatccgcctttttcccccctttcaagccgtatgactttatccagatactgctgtacttcgttttgttcgtgtgtcaccatgacgacggtgcggttgtgatttttcacctgatggtgcataaattcgtagaaaccctgcctgctttcataatcaaccgcggttgtcggctcatcaagcatcagcagatccggattgctcgcaagcattctcgcaatgcagattttctgcttctgtccgccggataaatcgccgattttccggtggcggaaatcccacatttccaccatcttcagcgcgttttccacctcatggtgatccgtttcgttcaatcgtttaaaccattttcctttcgtataacggcctgattgcacaagctccagaaccgtacttgggaatcctgcgttaaatgaagaaatctgctgcggaacatagccgattgtcaggcgttttccggctgcgttttttttactgatctcggccgttccttcccaaggtctgagcatgccgagcatgactttcatcagcgtcgattttgacgcgccgttcggtcctgtaatgccgacgaattcgccgcttttgatttccagcgacacgccgtcaagcaccggtgtatgcgaataaccaaaaacgatatcttttaatgtaacgagattcatgctgaccttcctttcccgcatagaaatagtgtgcaccccgcggcgcacactatgttatttaaccaatagcgaatctttcagtgcatcaaggtttttctccataatgtcgatataaccgatgcctttatcccgttctttttggcttaaaccttccagtgtattgagcacttccgttttcgcgccgatttcaccggcaagtgtatctgcaactttaggcgatgcaacttcttcaaagtagatgatcttcacatcatgctgtttggcaaacgttttgagatccgccagtttggccgcactcggctcttcttcaggagaaaggcctgcaatcgcgacttgttttaagccgtattctttggcgagatagctgaatgccgcgtgctgtgtgatcagttcttttttcgccgctttatttaatgttgtacggtatagtttatcaagatcctgcagttttgcaatatattctttactatttttctcatagtatgctttattcttcgggtcctgttttacgatctgcgccgtaatggttttgacctctttttgcgcaagaaccgggctgagccacacgtgagggtccatgctgtggctgtggtcatgaccgccgtgtccatgttcctcttcctcttcatccgaaccttcgagtaagtcaattcctttcgacgcctttacaaacttcgcatgatcagagcccatgcttttttccgctgaaggaacccatgtctccatatattcgctgttgtatacgaaaagatcggcgttttgaatgccggcgatatccttcggcgtcggctcccaatcatggggttcgaccgaagacgggatgagaatgtctacatcgcctttgtctttgacaatttgtttcgtgaattcgtacataggataaaaggtcgtcacgacgtgcagtttgccgctttttgaagaacctgacgaaccttttgaagatgaattgccgcagcccgccgcgattaaaaagcatgccgcaatgacaatgattccgctccattttttaaacaagccgtttccccctgttctgtaaatcagaatgataacgatttccaaagcgtactttctcgttcatttgttacctataccataataaaacgaagtaattacgttttgcaagatatttttttctaaattgatatccaatttacctaaaaagcccccgccatgtatggacgggggcgtcctatcacatatcaggcaagcagataaactcttgtttcgtatgggcggaatgtgatgcgggattccgtgccgctgtcattatcatagttgctgagaagcagctcggccctttcaggttcggaaccgtccggccaataaaaagcggcttcttctttcgatacgttgctgatggacatgagtttttgtccgtttgcctgtcgttcatacacaaacagctgcgggtcatcagggagcagcagcgtgtagctgccttttatgatatcagcatactgttttcgcaggcggatcagttttttgtaaaagttcaatatagaatcgggatcatcctgagcctcggccgcattgacggttttgtaattgggattgaccgcgagccacggttcgccctccgtaaatccggcattcttgctgccgtcccactgcatcggtgtacgggcatggtcccggcttttcgccataatggacgccatgacttcttccctgttccggcccatttcaaatacccttttatgatacatattgatggtctgaatatcttgataatcctctattctgtcaaacggagcgtttgtcatgccgatttcttccccctggtaaatgtacggcgtgcctttcatgaaataaagcagagcggcaagcattttggcggatgctttgcggtatgtgccttcgtctccgaaacgggatacgatccggggctggtcatgattgcaccaatacagcgtattccagcctcgatgttccagtttttcctgccaatctgtgagcactttcttcaaatcggacagctcaagcggttttacatcccaatgctcttggcccggcttttgatcaagctccatatgctgaaaatgaaaaatcatattcagttcatgctcatcggttcccgtgtagaccagcccttcttcaggcgtcactgatccggcctcgccgaccgacatcacgttatatttggaaaatacctctttcgtcatttcttttaagtaatcatgtatccgtgccccgtttggccgaaaaggcttcggatcggcccggcgggcgatgtaatcttcatatggcggcaagtattctttttttgacagaagatggagctggtctattcgcaatccgtccacgcctttatcgagccaaaatctcatcatctcgtacacggattgccgaacctcgggattttcccaattcaggtcggcttgtttgacggcgttcatatgcaggtaatattcgcccgtatgttcttcgtactgccagacggattgtccgtaatccgacacccaatcggtcggcgggccgtccgcggtgcccggccgccaaatataataatcgcggtatttgctgtccggattcatttccgcctctttgaaccaaggatgctccgtggaggtatgatttaagacgaaatccatcacaagctttaatccgcggctgcggcattctgtaagcagatcgtgaaagtcctccatcgttccgtaagattccataatcgcttgatgatccgtcacatcgtagccgttatcgacgtttggcgacgggtaaatcgggcagatccatatcacatcagcgccaagttcttttatataatcgagacgcgcgataatcccccgcaggtcgcctataccatcgccgttcgtatcttgaaagcttcgcggatagatttgatagacaacggcatctttccaccagtcattctccatcttgcggccctcctgttttttagagaaccatttcctttatgatccttccctaaacaaaaaagagaaggtttccccctctcttttatctgtccagctgagacggataaagcgtcatgcctccgtcgacgaaaagtgtcgttccggttacgtaactcgcttcttccgacaccatccatgcggcggccgcggcgacttcttccggttttccgaaggcgttcatcggaatttttttcagctgggcctgtttatgtgtttcatcttccagatccttattggactccgtggcgatcgtgccgggagcgatggcattcacccggatgcctttgtctgcgtaattgagcgccatcgtttccgtcatcattttgatcccgcctttggatgccgagtactgcacgttttcaggacggggtatttgctgatgaacgctcgatatgtttaagaccgttccttttttgccgcgctcaagcatatgtttcagtgccgctttcgcccccaaaaaggtgccggtcacgttgacgtcgatgaccctttgccaatcctccaggctcatttcatggggcatcgcttcggccccgttaaagccggaattgttgaccatcacgtccacacccccgaaatgctcctgggcggcatcaaacagcgcctgaatcccttcttctgaggatacatcggcttttacggtgacggctctgcctcccgctttctcaatgatgtccgccgcttcttccgctccggcggaatcaccgaggtagttcacaaccacattcatccgctccttgccgaagcgttcggcaatggcttttccgattcctttcgaagaacctgttacgattgctgtttttccctgtaaatcctgatacattgtctcatttcctccctgatgttaatacagagcatgtacccggttttgatcggccgaaaacaaaagagatcataaaaagaacgatgaagccgaagctccctcgttctttttttcattatgcgtagttgttcatttgcagccttttttgcacgccgacaagcctgctgaaaaaataagatgccgctttgtagttctcccgtttatgaaagaaatgagccgcgtcctgaagcagttcctctgtgtcagccaacagctcttttgattccagaatgtcaaaatactctttgagtgaatcctgtccgccttccccctgataaagctctttaatcagacggaatttcgtcatatagatctcatcttcccactccgccgcgcttctcatgccccgcgcgcagctggcggcggcttcactgtatttttccgttttaaagtagatatgcgtgagtgaaaaaacagcctggatgacctgccggaagctgtgtgcttcaaatccggcagccgcccgttcaaaatcctccgccgccttgcaaaagtcacccagactgtacatacagtgcccgatattataataggccgcagcaatcatatattgatcatcaagccgctccgcgtgctccaaggcgcattcgaggtattccagcgcttttttatgctgctgggcgtccatcagatttccggcaatgataaatttgcactgcacccttctcattccgtataattcatatttcttgtaaatatcaagcgcctgccccgcgtaattcatcgaaaagaaagtctgcttgatgtgatagtacacctcagaaattttatacagaaactcggctttctctatgtcatcttccacatattcaagcttttcctcagcccgcttataatgagaaatcgctgagatgaagtttttctgcttaaattcatacattcccctgaaatagtaaaaataatattccagtaagccggtcagcttttgctggttcatctcaatctcagtgagcatttcagagaacggaggctggcagtcgccgtctttcatgggttttaatttatccagcatgatgcggtgccgaaattccatcaatgaaaaatacaacaataaatcctggttctcttccatatcttcgagttcatattgaatctcccgcttcagcgcttcagcttgatcggcttcaaacgcgcggatcagcttataccattcattcatctttacggccacttcttcagatggaatcttggatttcatagattcgcctccttcctccagctactaattatgttatattttatcatagcaaatttatggcagtgagcaaacaaagattttaatcaattaaagaaagagagaattcaccatgaaacgaccagtcagaattgcgctgcttttgatcctcttcttttccgcagacctatgtttttcctatgtgcagaaagaattgaggccgcagacggcattacaagatagagccattccaagcgctcttcatccgctcgtgaaacagaatgcggagctattgcagacggccgctctgaacaaaggcatcaccgtcgttatcacagagggtttcagatcaattgaggaacaaaacgaattgtaccgtcaaggacgttcaaaaaaaggaaatatcgtcacctacgcaaaaggcggggaatcttaccacaattacggccttgcgatcgacttcgccctgcaaaaaaaggatggaagcctgatttgggatatgacgtacgacggaaaccgaaacggcacgcccgattggcttgaggtcgtatcgattgccaaaacgctcggttttgattggggaggcgattggagaggctttaaagattatcctcatttacaaatgatccctggctaataaaaccttttcttttttcgcttttgcgcatcaatgtacggaggatagacaggcctgtacacaagcttatatccttcattgccggacggcgtaaaatcgcgctgccactccagccgcagatggaaatcggataaaaaagcggcctttgcttcttcgggagtaacggccggcaccggattgatcttctccagctgctccgggtcaatgtcaggcgccatgtaagcttccacaagccccgttacgggactgacaagtattctcgcagcgccgaaccgcagcggaatatcctgatgccatatggaaaaatggaagcggaacctgccccttccgtccgttttcagcgggttcattttaaaaaactcgtccgctctcggataaagcttgtataaaaattgaagcgcgacggcctcacactcttccgcagaataaaaggccgggccctgatgctcaataaaagatttaaaggctgtcattttccctgactttttgtccgttttcatcttcattgtatttttgttgctgctttcaaaatagctttcgatactcaaatctttccgttccggaaccgaccctttccgccatgtcgttccgatctcatccccgagatcgcgccggcgcgtctgaaccatatccgaggtaaaccccattaattcatccaggctgatttcccgtttatgttcaaacgcgggaagcggttttgccggctcattcctgtcttcgcaaagctgctgatccggcacgatatcatcttcaccggccggatagctgtaagccggcagaatcggttcatagacgagacgcggtattttctcaaaattgaccacatcatagacgagactgaatgtcagcacactcatgtaatgcgagacgactttttcccgatcgacgaatgtttccgggacgggcgcttcacccttatccccgtaatagataaactgcacgacgaagccgctcctggttacatcaacgaaaaaacctgaatcgggaagcggccggcagagcactttttttgtatagataaatcggatgcacccattgcgttcttccctcgcctgaaagatgaaattcataaaagtaagcgggcggtgtctcgccgcaaaccgaagagccgtcagctttaattcggcgtctgacagctgcatgtctgaacccggacagtcgttgcgtgaataggtaagcaaagatccgtcgtcgcccagctcaatcgtgaccgttttatccggatggttacgatctttccatatataataggctttcgttttttgtttttcatcataatcttctatttcaagctcatagtccggcggtatgttcccgatttccagcgctttttttctcagatgttctttcagcaatggggtcatcctttcagaagagtgtataaaaaagaactgttttttattatataaaaacgtccttatccttttaaagggaagaaagtgccttttatgtgtctatttttagcaaagagggaaaagagccgtattcagagcggctctttttcatacaaatgtcacattccccgcgaaagccccgggacgaacgcccatgaccttcagcctattaaactcgtgatcgcttcccctgtatgagcctcaataaacagcgggaaaaccggcttgtatacgagcctgtacacttttccgcagctgtcgtcatcgtaacaacgatcccaagcgagctcggctttgatggcccggcggatcgcgtctttcgcctcttccattgtcaatgaaggaacgggatcgatttcctggagctctttcggatcaatttccggcggcatatatacagtgacaagacccgtctttttgctgacacagattctcccctctccgaatcgcaaatcaacgccgcccgaacaagccttatatgtaagtcccacgttttctccttcatcatccggctcatcatattgaacccggaaatactgatccgcttccggaaacatggcgaataaaaagcgaatggccatgtgatggcattcttcctcggaaaacctcggttcgccttcaacttttataaatgacatcaccccggtgagccggcccgattctttatcatgcattgttttcaatacgtgttcattccgttctttaaacagactttcaaagcttttatcttcccgtacggattttgttttttcaggacgccaggcaacgccgatacagccctctccaagatcgctttccctctctttataaaaaccgtcgtgcagcccgatcatgtcattgatgctcaacttttccgcttcaggtgcagggcgtgaaatcgggacatacggccgcgtgtcgtcttccagctcttcatattcgtctaattctacattctcttccttcaggtcggccgatatcggccgggtcggagacacgatttcatagacgagatggggcttgtcatccccctgcacatagacggactgatgcaggacgctgaacaacagctctgcttcaatatgtttgacaaagtgagccaatgcttcccgcttgtccgcaattgtctccggtcttaacagatcatcggccttcccatggtaagaaaagccggttacttcccctgtcacagccaggtcgatgtaaaacccggtcagcggaagcggcagaccgtcagccatctgaacataggaatatctcacatcgccatcatttgcgggtccgtttttttccggttcaaactcagccaatgcccccggacgatgggtttctaaaaacgcccgcatccgttcttctatgtccgattccgaaagagccggcagatcagtctggaaagccggacgggataagtatttcagttttccgtcccggtctaattcgacaatgatgccggcttccggatcattcttatcttcccaccaaaacagaacctcatcttcctggtattcttccacattactctcgtagcgggcaggtacgtttccgattcggagagccagctgtttcaactcttcttttttcatcataacacttccttttcttccaaaaagattgatgattaccaagactcttttatacaaaactagtataattaacctgtctgtcttcatgactatcgaattaatcattaacaacagggggtaaaccagatgtccatcaaaaaaatgagcgccgtgtttttcattctgcttctcacggcatttaccgccgcgtgcaacagcgaaacgagcggcggccaggaaagcagcacggcgaaagtgaaaataaaagagacggcatgggccgcttcagacgatactgaacatccggccgcgctgaaagtaacggtcaccgtcaaaaatacgggcaaagacccgcttaccgtcaaaagcagcgacttctcgctttatcaggatgacgcgaaaacagccaagaccgataaggaagacttgatgcagagcggcacgcttcatgcgggtaagacagtgacgggcaatctgtacttcacggctgacgaaggcaaatcctatgaattggtatatcagccgcaggcaaaagacgcgaagcctttatcttataaactgaaagtcaaaggcacagcctccaacacaaaacctgacccggcggacgcattatccgcatacattgatgtgatgctgtacggcaagcacaataaagatttcacccgcctgaccggtgtaaatgaaaaaatgacggccgccgcatatcaggaatcggcgaaagccagctttatcgcttctgcaggtatatcacaagaacaggcggattcaaaagccatttccgctattattgacgccatgtcatcagcgcttcgggataacacagagctcaaggtgcataccaagtccatgtcaggcaaaaaagccgtccttgaagcaaaagtgacgccgcttgatatgtctccgcttgcgggccagctgcaagaccgcgtgcaagactatgccggaaagcaccctgatgctgatgaaaacgaaattgtcagccacctgctttctgtctatccggaagagtttatgcgcctcaaaccggcttcttcttctgttacaagagaaatcgagatgaagaaaaacgcccgcggccagtggtatctggatacagacgccgatctggaaggattgacagaagcgtttttgaaaacgtcctgacaacaagaaaggaaatagcgcaggctatttcctttttttattttcacttaaagatgtcactgatatattgaacctcatcctcggttaactgcacatgaagcgcgtccagattgtgtttcagctggtcggggcgtttggctccgggaatgatcgcatccaccgccggctgcgacagaagccatgcgagtgcgatatgcgctgtctgcgcccctttttcctccgcaacggcccgaagcttatccactcgctccagattttggtgaaaagcttctccctgaaacggcggcctgttctttcggttgtcctcaaagactgtgtcttttgtaaactttcccgtcagcaagccggaagcaagcggaaaataaggaataaaggaaatgccgttcttttcacaataaggcagcagatcatgctccgcctcacgctgaatcagtgaatattccgattgaaaaacctctaaatagccgtcggcgttaaactcctgcaattgccggaagctgagattggacgcgccgattgctctgattttcccttcgtccttcagttcttttagcgtgcccgccacttcggagagcggtgttttgccgtcagggaagtggacgtaatacaaatcaatcacgtctgttttcagccgcttcaggctgttttccgcctcactccggagaaattcacggctgttgtccagctcgatttgtccgttgacttctttatgcgcgccttttgacgcaatcacgaggctgtcccgcacgccgcgctctgcgacaacttcaccgattaactcttcggaacgccccaaaccgtatataaacgccgtatcaataaaattgacgccgccgtccaatgctgtgcggatgagttcttttcccgtttcatcattaagattcggaaacagattatgtcctccgaccgcatttgcgccaaaaccgatacgctttacccgtaaatccgtcctgcccagcgtacgtgtctcatccatggctcaggctcccttccttttatcgctctgtttagtattagatagacggtaagaattatcctgcctgagagcctatctacagaaaaaaccttgaaaagcgtttgcccttcaaggtttttttggctgtgtattaagatgtcagagctgcggcgaagcgttcggcttcatccgtgagagcaccctcgatttccttatagcggctggaaatcgttgaggcgctgacgccgtacttcttcgccagcttggcttgagaaacggacgcgccgttcagagaaatgctgtttacgtaatattcgaccgccgccgcgaaagcttcaggctttctgatcgtcggtgtttttttgatacagaacgttttccacagatcaattacggccggaaccagctcagccgggtattcatccccgctcaggcctttttcaatagcgtctgccgtttccttttccatgtcgttggcccactctgtctgtttttcttcagcagcctgctcaggctcttccgccgttcctaaaagagcggccagcacaatgtcgaagttgtcctgcataaagcgctcaggcgattttccttccgcaagagccggggcagccgcctttttcactttgctgattagagcttcggtccgcttcacagggaagatcgtaaattgcatgaagaactccgctttttccgcttcgtggatcggatagccgagaatcaggcttcccgccggcggaagatcctgctggctgacgtccatttccactttgaattgttttttcgtcatcacatcttcaaagtgaatcattccttctttcacatcttcaagcaccataacggcaggtgtcatgcttttccatgattcaacgatttcccgtgttttcgggcggttgatgccgccggcttttttctgaagatattcttcaaaaatcgtcttgccgcctgccagcggacggaagaaaattccccagatgccgaggttgaagactccgatgtcttttgtctgtctgtccagctccgtaatgaacgcgtgctggttaataaatgatgatatgccgtctctatgtgctgtaaaggcgtactccattaggctttcctgaatctgtttcgcttcttttgccgcgatgtctgccggaatggcagcttctttgcttccgcagcattttttatatttcttcccgctgccgcatgggcaaggggcatttcttttcacttttcccacaataaaccctccgaattctgatataactttattattttaacaaaaataacttcagagggcttggtttacggcgaaaaaagaatatggaagaaaaaaagaccccgggatattctcattctccggggcttcgaaactgttaatttgtattttgtccgccgccgttcagaccttctttaatcagcccgtttacttggctgttcatcaaaagtccgatgtgtccgacaccgtgaatctgcacgtttttcccgccgatcagccgtgacagcgggttcaggacgattaagtccgctgagctgtaaatcgatgtatataaaatcttttggttcggatcagtccccggaagcgcccggttggtcacaaggccgttcgctccgcccagtgtgacgacgtttgcgattttgtctccgccgtcaagatttttaatgtaatagagcgtgttggcgccgcccatgctgtgcgcgacgatatcgacttttttcgcacctgtttcgctgagcacttttttcacgtaattggacagtctcggtgcattgtgtctgttgtttccggttttgtccagaaaatcaatggcgtacatctcatttcttgaccagccttgggatgccaagtacgttttgattcccgcgaagttaaaggacgccccgccgattccgtggaccatgacaaccgggttatgctctgaggaggctttcgatacggtcggctggaaggcaaatacggaaatgacggagagcatgcagactgtaaggatcgctaggattttgcttttgatttgtttcatgaactttcctcctgttatgtaattttttgcaattttcattttattagagaagaaaaggaaaaaatagagtattttttactgttttcaacaattgaaaaagaggcggaaaaatgagaaagacgcccctttcccgaaagcacacttatactttaatacggcaaacaaaaaaaggagagaacacccggttctcttctcctagtactcattaaaataggtttgaatccgcttagggtcatgcgtttttgtcagcgcgagcatcagcagaatccgcgctttttgagggttgagagagtttgaagctgtcaaatggtctttttcatacgctcgattaggtgttaccgttccgtttcccgtccttgtggagcggacgaccgccagcccgcttttgaccgactttacggcgcctttatgcgccgcatcagacattgagccgtttcccgggcctgcaaaaataatgccttgcgcccctgattttacggcagcttcaaagagatagcttccgtcattttgatagccgtatataatatcgacttgcggcagtttatcaagtttgtctatcttgaaatctgtatccttcgtatgctttcgggtcatgatgttattaaaatagatgtcatcagcaattgttccgatataacccatttcttccgatttgaatgtgtcggccgcggttgtattggtttttgtcacatagcgcgccgaagcgattctgtcatttaatacgacaagcgtccccttacctttcgcatcaggcgcagccgctgtttttacagcgttatataagttggacggcccgtctgctccgatcgccgtggacggcctcattgacccggcgacaacaacgggcttgtcacttttgaccgtcagattgagaaagtaggcggtttcctcaagtgtgtctgttccatgtgtaatgacaatgccgtctgtatcatcagacttgagcagcttgtttacccgttttgcaagtttcagcagtgtctcgttattcatattctggctgccgatattcacaacctgttctccgctcacatgcgcgacctcttttatctccggaacggcctgaatcagggcatcaactccgattgcccccgccgtgtactccgtagctgacgtctttgaaggagcagcgcctgcaattgtgccgccggtggcaagaattttaacattcggaagtccgtcttttttcgctgaggctgcggctgccatccggggcggtgtttctttcgcttgaggagattgggagcagccggccgcgatgaagagcagagccgtgataaatgtaatgaagggcatgaattgttttttcattcttttctctccttttctttatttatgaagattttcctctcaccggtcaacgcgcttgtcaggcaacctcccgaagaaaataaccgttaaaaaaccttgacaccgtcatgtgaaatcaagataatagaccagtcactatattttaaatttgtcaaaaatcagtaaggtgggaacattatgagctatggagattctcgtgaaaaaatcctcgccgcggcaaccaggctgtttcagcttcaggggtattacggcacggggctgaatcagattattaaagaaagcggtgcgccgaaaggttctctttactatcattttccggacggcaaagagcagctcgccattgaggctgtcaatgaaatgagccattatatccgtatgaaaataaaagaaagccttgatgcccatcctgatcctgcggaaagcattcaagcgtttttacaggacttatcaagccaattcacatgtccggaaaactttgaagggtttcctgtcggtttactggctgccgagactgctttaaagagcgaaaagctccagcaggcctgtcaaagcgcttatcaggaatgggagaatctgttcgcgggcaaattgagatcagccggtttttctgatgagaaagcggcggaaatcagcactgttttaaatgccatgatagaaggcggcatcattgtgtccttagccaaaaaagacaaaatgccgatcctccatatttctaaacaaatcccgaacctgctgaagacataaaatacgagagacatgtacgtatagaaagagaggagaatgattttggaaaacgctcagccttccaaacaatataaagtcatgccgatcatgatttctttactgacggcagggtttatcggcatgttcagtgaaacggcgctgaatatcgccctgactgacctgatgaaggagttacatatcactcctgcgaccgtccagtggctgacgacgggctatctgctcgttctcggtattcttgtcccggtatcgggtctgcttttgcaatggtttacgacgagacagctgtttatcgtttcactcgctttttccattatcggcacgctgattgcagcgcttgcaccgagctttccgtttcttttggcggcaagaatcgtgcaggctttaggaaccgggctgctgctgccgctgatgtttaatacgatcctcgtcatcttcccgccgcataagcgcggagcggcgatggggacgatcgggcttgtcatcatgttcgctcctgcgatcggtccgacattttcagggcttgtgttagagcatttgaactggcattggattttctggatttccctgccgtttcttgtgttggctcttttattcggcatcgcctacatgcagaacgtgtctgacattacaaaaccgaaaattgacgtgctttccattattctgtctacaatcgggtttggcggcatcgtattcggattcagcaatgcgggcgaaggatcagacggctggtcaagcccgacggttatcggttcgctcactgtcggtgcgatcgcgctcatcttattttccatcaggcagctgacaatgaagcagccgatgatgaatctgcgcgctttccgctatccgatgtttgttctcggtgtcgtgattgtgtttatctgtatgatggttatcttatcgacaatgctcctcttgcctatgtatttacaaagcggactgatgctgacggcgtttacgtccgggctcatcctgctgccgggcggtattttaaacggctttatgtctccggtgacggggcgcctgtttgacaaatacggaccgaagtggcttgtcattcccgggtttgtcatcacggccgccgtactttggtttttctcaaacattaccggcacttcaacggccattctcatcgtcgtgctccacacatgcttgatgatcggcatttccatgatcatgatgccggcgcaaacgaatggcttaaaccagctgccgccggaattttacccggacggaacggccattatgaatacgctccagcagatggccggcgcaatcggcactgcggtggcggtcagcatcatggcagccgggcagaagaattatatgagcaccgtgaaaaacccgaatgatccttccgcatactctcacgcgctgattgcgggcgtccagcacgcctttatcttcgcgatgattgtcgccgttatcggcttgatcagcgctttctttatgaaacgggtcaaagtgaatcactcataagaaaacagcaggctccccgtgagtctgctgtttttttatatatcgcgcgcttcagccagttcatcaatcgcatacatcagatcatcggccgtgttatagaaatgaggcgccagccggatgatatgtccgctgggtgcgcatacgatgtttttccgcctcaacagcgcagccgtttccgccgctttttcatcccgtatggaaatcatgccgggtctgtcatcggcagacggcggccctgtgagattcaatcctttttcagaagcgtattcatacgcaaatgcactgagtttttttacttcttggtgaatgcggtctgtgccggcatcgtttactagagataaagccgcctgtgccgcatatatgctgataaatgccggggttccggtctcaaagcgtttggctccgtccgcataagaaaaacgggttaaatccagcatcgacgcccgctgctgcccgaaccacccggtgactttcggcttcagccgttcggcaagttcctttctgacataaagaaacgccgttcccggtatgccgagcatatactttctcgcacccgcggccagcatatcaactccccattcttttacatcaatcgggatgtgccccgctgattgataagcatcgacaaaaagaagcgatcccttctttgcggatatctcggcaatgcgcttcatatcctggacaaaaccggacgtatatgacacatggggcacacaggtgaaaagcgtctgttccgatatgtacgtctcataccgctctaacgggatcattccatcttcagacggcacgactgaaagctccatctcagtctgtgccttcaaaatgtgggcgatcgccggaaaatccaattccgtatacaccgcctgtttctttcggcaatccggtaaagcggaaacgacggcagagacagcagccgttactgaaggtaaaacggcgatttcttcaggatgggcgccgatcaatttcgcaaattcacaccttgcctgctccgttcgtccaatggcttcttcccagtttccgccatgctgaagcaggctttcctgatagtcattgatcgcttttgaaaccggcagggcaagagcgctttgagagcagctggcgagcatcgtatgtgtgcggagcgccggaaataaagatcggtattgcaccagaggcgaattcaagacgtgtttcccccttcggcaggaatatatgtccattatagagtatggtaaaaagaaaaggagggttttatatggagaaaaaagtattgctgacaggctttgaccccttcggcggggaaacggtcaatccttcatgggaagcggtcaaacggctgaatgatgccgctgagggccctgcctctatcgtatctgaacaagtgccgaccgttttttataagtctcttgccgtactgcgcgaggcgatcaaaaagcatcagcctgacattatcatctgtgtcggacaggcaggcggcagaatgcagatcacgccggaacgggtcgcgatcaatctcaatgaggcgcgcataccggataacgaaggaaaccagcctgtcggggaaaacatttctcaaggcggtcccgcggcctattggaccggccttccgatcaaacggatcgttgaggaaagcaaaaaggaaggcattcccgcggctgtatcctacacggcggggacgtttgtatgcaatcatctcttttacgggctgatggatgaaatcagccgccatcatccgcacatccgcggcgggtttatacacatcccgtacattccggagcaaaccttgcaaaagtctgcgccgagcctcagcctggatctcgtgacaaaagcgctcaaaatcgccgcggtgaccgccgcggcgcatgaggacgatattgagaccggcggaggcgaacttcactaagctgcagacggcgcctcggcccatttcttccggtaaacgatgcgggacagcgtcacactgatttcatagaggacgagcagcggaatcatgacgagaaagtcagacataaaatccggaggcgtaatcagcaccgagacgacgatcagcacaaaatacgaaagcttccgcgcctttgccagccgggttggattcacgattccgagccgtgtcagaaacatgacggccagaggcatttcaaacaaaaatccgaacggcaatgtaagattcagcataaaggtaaaatacttgtccgccgtaaataccatgtcaaaatggccggcggataattgtgttaaaaatccgagcacaatcggaaacagcacaaaatacccgaaggaaattccgataataaacaaaaccgaaagccccggaatgtaaagcaaagcggcgcggcgttcaaacggggtcaaagccggcgccgtaaaacgccagagctgaaaagcggcaaccggaatcgttgccgtaagggcgcatattcccgcaatcatcatatatacccataaaatctcgctcggccctaaaacggccagcctgccatccaaatccttgatcagccagtcataaatatcctgcacaaaccagcaggcgccgataaaaaacacgagaaaggcgataacggttttaatgagacgctgccggatctcctctaaatgcccgatcaagtgggtttcttttttatccaatcgtacatcctccttatagagaaagaggcagaagcggattcgtctgcccccatgtcaggattcagcctgccgttttgtctttctcagccgtctgcttgtccggctcttcatttgagaccagtgtttttgcggcgcttttaaattcaagcagcgtgcggccggcggcacggccgatttccggaagctttgaaggcccgaaaatgatgagagcgatgacgaaaatcaggatcaacccgggaatgccgatatttgaaaacatgagtgtgcctccttattgtgagatttttgcccgtttctttctcatttgcttttcatgcgcattgttatgggcgaagaaacgatcctcttccacctcgtttgactgctttaaaccgcctgcaaccgccgcttgagaaaccttccgaatccccgtctggtctttctgataaatgaatgaagcccgcgtggatacctcagcccccggctccgtcacgtacggcaccactctgtaatccgctctccattgggcaggggtcaccgtacagcggacatagccgcggtaatcgttgaaaaacttaatatgcgggttttgttttaagatttgatccgtatcggcccgtttatccgctccgtttcctccagatgtaatggaagtcccgacgaattcggctccgaaaatctttgaattcgtttgattaaaatcggtatgcaggtttgacgcccagcttgcgtgaacatcacccgtcagcacgatgacattgttcaggtttttgctttttataaaattgatgacccgctcccgctgagccgggtagccgtcccatgaatccatgctgtatatcggattggcggttgttccgaaattccattgcgcgaaaaagatttgctgcgccagcacattccacttcgcttttgaggcggctaaatttccgaagagccattgctcctgttctgtccccatcaatgtacgcttcggatctctccactcatcagaaggcggcttattcccgtcgccgttggcctgatcatctctatactgtcttgtatcaagcacattgaacgatgctaaattgccataagaaaattgcctgtacagccgcatatcaggaccgttcggcaatgacatgcgcctgagcggcatgtgttcataataagcctgataagctgcggccctcctgagcacaaacgcttcaacggattggcctttttcagggataatattggcataattgttttccacctcatgatcgtcccacgtcacgacccacggaaatgcggcgtgggcggctttcagattggcatcagagcggtattgggcatgacggttgcggtaatctgacagtgtatacacttcagcgctgctgtgcgtcctgacatttcccgtttttgacacatattcgttcggtccgtattcataaatgtaatctccgagatggaacacgagatcaagcttttccttcgccatatgtttatacgccgtataatagccgtgttcatactgctggcatgaggcaaatgcaaacgtcatggcggatacgtcagcaccgggagctggcagcgttttcgtccggccgacgggactgagctcatgcccgcttttaaaccggtaatagtacactttattgggcttgagcccgtccgcctcgacatggacggagtgtccgagattcggcttggccatttccgttccgcgtttgacgatgtgacgaaaatgttcatcagcggcgatttcccattttaccggcacggcctgcttcggcatgccgcccccattcagcgggtcaggggcaagacgcgtccagagaatgacgctgtcagacagcgggtcgccggaagctacgccgagggtgaacggatagtttgaaaatttcggagcggcattcacttcaaacgcgccgatggattgcgcgatcgctaacccgagggaaagaccggcgattttcccggcgccctgtataaatgcgcggcggtcaaacgtattgttctgaaagcttttgttctccaattccttgatccattcatctaaacggccgtcatgtgtcatgtcagttcccctttcgtctcattgatcgcccttattataaaaaagaaatgttaaaccgctatgaagaagtgtgaagggtttgtaaggctgaaaaatggacggcgggagacatttttcacattgtttcgacaaaccttgccccgccgggagaaaaccccctctgtttctttttggcttgtcatccgtcaagcgaacttttttcctatttttcttcacaagaaattaaaaaaacaccgttcattctcagaacggtgcgcccgggattaaaatgtattgtacacgttttcgcacgtctcacctgtcggctgatagaagcagtgggatttgaatctcgcgacaaacggctgatcataccaagtcggcgggcagtttcccggcggcttaaaataccacagactgaacttagccggccaaaaccgttctccgttaatcgtccggcgggcaagcctccgctcggattcacgcggtctctggtaaaagtatccgtgagtcaccgcttcaaacgcgtgcggctgaaacaccatctgcctgatggtgcgcaggcctttaaaatcagaacaattcgcccgcacccgattgattcccacattgccgaccaaaagcattccctgcttcccttcgccttccgcttccgccctgagcagccttgccattagatccagatcggcgctcgacgcttttacgactgccatcatgacacctcccgtattttctcccttcatcatattcagccgcggcccagtgatgacagacaaaagccagaaaacaaatgttcacgaaaaaagggtttatatttcacgttatgaggaaacatactaacatgatttccataaggaggaattcgcatggaacacattaaagcgcttgccatcaaaggcattatgaccatcattattctgtatctgatactcggcttaggttttcgctttacattcggcgacgtgctgctgatgaccattgtgctgggagccgtttcttactttacgggcgacctgtacgtgctgccgagatggaataacatcacggcggcgtccgctgatttcggaatcgcgtttcttgttgtctggctgatgggaatgccgctgtccatgggcatttccggaggaagactggcgtttgccgctcttatttccgccgtcatcatcgccgtcggagaatattttttccatatctatctgatgagaaaagacttgggcgggtcccgttttttagaaccccggtccgaataacgtaaaaaaggccggataaaagcccctttaaagggggctttttatttgtaaagtataaacgctttatacatcttgatataactgataaacccttttcagcctttcttcgagctgttcaaaatgaacaaagcgggcttctctcagaaactcagtcccatcaatgaacaaaagaagcacgggaacagtgaagcctgaaaatctgccggccacctcttctacctcgtcagcattgatatgccccaatttgatattcggaaactgatccaatacttttctgagctgcggcagaacagcgtgacatactgtacaggcgggtcttgaaatgtagataaaactgaattgatgctgtttaataaaattctcgatagaatctaatgaatgtaattctgccatctctttcaacaaaaccctcctccaatcggctcgtctttcatgaccaagctcatcaatacgcgtacattcactatacacatttatattgaacatatccgcttttttgctattcagagcacctgaacgttgtgcttgaaaataaaagaacagttaccgcttttcagtaactgttcttagatacttatattaaaaatgcaaagcgtacgcccctgaaccgatgagtgcaactccgatggagactgcaatcagcaccaagttatattcaaaaccgccggcaccgttggcaaatcctttcgctccatggacttttacgatggcacctaacataataatcgttataatagcagctccgagcgggaggaaaacacctaaaataaatagaattccgcttgcgagttccccgagacctgataaagcggccgcggcattacctggtttaactccaattgactcgaaccattgtccggttcctttaattccgtatccgccaaaccagccgaataatttttgtgatccataaaacagaaacaccacaccaatcatgattcgaataagtaatagtcctgcatcttccatttttatctctccttatttttcatattatatgatgtctgcaaggcagctgtttaccaacagtcgcttccagcaaacatctgttaaatgtatgtcttgttatttttcttcatgcttcacgttcatctatcaatcaatctaattctctcacttcaaacggcagcagcccttgttcaatttgtgcccggtgcggttcatactgctcagggagcatcagttttccgcccattttttcttgtgactcatcatgggcaaagcccggcggatcagttgcaatctcaaataagatttccccatgttctctgaagtaaaccgcattaaaatagtttctatcctgaacaggagtcacaccatatccgtgcgcagcaatgaacctttgccaatctaattgatcttcgtcatcctgagcccgccaagcgatgtgatggaccgtgccgatacccatttgcccgcggccgataggcgttaacttaaggtcaatcacatttccgatatcaccggcagaacgataacgaacgaagtctccttctttaccgactcgctcaagccccatgatattttccagcaattcacctgttttttcaggctgtgctgataacagggttgcaccgccaaagcctttaatggcaacatccggggttacatctccgaaagtccacgtattggcctccactgcttctctttccacgatttctaaatgcaggccatgcgggtcatcaaattctatatattgttctccaaaacgctcgatttttgtgtatggaatgttgaacttttcaagtctcttttcccaaaacgccatggcacccttcggcacggcgtaagatgtcacgccaacctgtccgtctccaatgatgccttggcgggcgcccgcccacggaaagaatgtgatgattgttcccggcttcccgccttcatccccaaaataaaggtgatacgtacccggatcatcaaaattgaccgtttgcttaaccaatcgcagccccagcactccagcgtagaaatcagcattctcttgagggtgaccgacaattgccgtaatatgatggatgcccatcgtttttttcgccatttttatttgcttctttacaaatagttaaatatactccacaaactcattcacaggctttcggtagccgcgcggccttctgctttctattttttctttcccgattgtaatcatcatgacgacctcaaattgatcatctatcttcaaaatctgtttcacggcttcagcatcaaaccctatcatcggacaggtgtcccagcctttttccttagcactcagcataaacatcatcgcagaaagtgaagcatttcttatcgcctcatctctcttaaatggttctcccctgttttcataaaacgaaacggtgtcttgaaccatgtgatcatactcttgtttatttaatacccccagcatcttcaatccttcatagatgtcagccgcttgctgatatgcctgcttatcccctaaaaccaaaagaacagctgatgagctaaacactttatattgtccgtttgcggcctgtttcagcttttcttttacatccgggtcaagaaccgtcacatattttgtgtgctgcaaattaaaagctgatggagccaacgcaaccaattcaaacatttcattgagctcatctcttgtgattggatgttctggaagaaagttgcttgcagatcttctttcattcactagctgtacaaattcagccatttccctcgcaccccttttatctcgaattcgagatattatagtataaaaaatcaaataacgtatgattaaaaaacgaaacgttctcttcactgatcttttcgtgattcaaacgatcggcaggttcttatactgcactctaattaaattatcttgaattaaaaaatcttgaattcgagataataataaaagataaacactcaaatgtcaacagttctttttttaattcagcgccattttgtctgtgtactgtttagccctgctccaactttttttctgtcaccttatttattaggaaacaggaaacaaccttgctatagacccactcgaaactgaattggtacgataagcaaagtgattacacaagaaaggatacggagagcgaatcaaaagcgcctctatttttttgtgcagttttataggaggaaaaaatgacaagtgaaagagaacaaataagcaaaaaagttgctttgattgcattgatagccaatctgatcttaatggcaggaaagatcttttttggactgataggcgatagtgaagcagtttttgccgacggtatacattctgcagcggatgtcgcggcttcaattgctgtcctggccgtcatcggcatttctaataagccgcccgatcaagaccatcctttcgggcatggcaaagctgaggtcatcagcgaagcgattgtaggaatcatattagtgctcgtttccgtgtatattctgatagaagcgatttcgtcctttgttgaaggtccaagcatcccgcaatacagcgcattgtttgcggctctgatatcctacgcggctaagcagatcttatatcgttattcgatcaaacaaggggaaaaatggaacagtaaagcgattatagcgattgcatacgatcataaaggcgatatcgttgcctctcttgccgcttttatcggcgtcctattggcgattatcgggaacacacgcggatggtcctatctgttgtacgctgatgcaattgccagtgtcatcgtggcgtacctcatttttaagatttcaatggaattaatcaggccgtctgttgacgttctcatggaaaaaagtgttgatcccgaactgatagaggaatataaagccgttattttgcactgccctcaagtcaaacggctcgataaaatccgagcaagagaacacggccactataaattgcttgatgtccggttatctttggatcatgatttgacgattaagcagggacacgatattgcccgcgaaatccgaaatgaaatccaaagacacttttcagatgttgaagaagtgctcatccatgtgaatccttattttgaagaatgaaaaagcagcttgtagagaaaatgatgtttttctacaagcttttttgttttgtgctgtttctttacatattcatttgatttcaggtgcagaaaaagcactcccacatgcctagctttgcttggctgggtatgtggcaatcttcaacatcattttgaataagatcagcggatcaagtgagggggggctttatttttgttgcagtaaggtttgaccttttcaacgatgaaagagaagtctatgtatttatcaatttttcgaagaaggtgatcctcttcgacgagttggtcaaacagaacgaattcggctgtgtttcgagaaaaatttcttgtgtggaacatgagaaagaaaagacaccgttttttcagtctttcttttattttatgacaagagaaacataaaggctgtcgagattttctcgacagcctgaaggccggataacggcctttttcgtttgatttcactgatcaatatgctttctgataaaatgcagcagcgtgtttccttgagcggtcaatatgacgcccttcgcgccgcacttcggacagggcgtcccttccttctcctcgccggttccttcacaatgcggacacgtgagctcaagatcgtcggttgcgatcaccatgaatatccctccttttttgattgtctgtccgtctccagtcactttccatggccatcacctccttaacaatacaaaaaaaccccgtccatcaaaggacgaggttttcgcggtgccacctttattaacggctgataagccattctctcaaaaagtacagaaacacacggtttcaatactcctttcttgataacggggaagaatcccggcaccgcctactgtcatttcagcgcagcaattcagaagcccattcggcaccggacggggatcggttcacagcggccaccgactctctgaaccccgcgcgctgatgcgtacttactcttcctcagcattgttcatccgttcttttattttaaaatgtatcatacgctgtcatccggcggaagtcaataacctttcggatcggtcaggccgagcatgtcccgcgccatttgcatatgctcctcttgccccgtctgaagcgcgaacttcgccgtttccacagggtaagcggcctgccattctgtcacatgctgattttcgtttacaaaaatatgcggaggatgcaagtcgccatggatcagcacggaaaaatcaggccagtacgaactgtcatttatccacgtttgccatcttttccaaagccagcttaccggctgcctccgctgacaaattttgatccttcgcgtaaatctttcgcctccaaaaagaagacgtgaatgaattttttcatattcactttaaccggagaaagcggcacggtttccttagcctgcatttctttcattctcttgctgacagcggggaaatcaaagaatttcgaggcgtaatattcaaatttggggtttgaaaaatcagttgtgcccaatgaagcgaaatggtttaacgaatgaatgacggcccttctgatccgctgttccgaggctttgatttccctgttaacctcggcttgtgccgccgcaggccccagcttccggatggcgacgtttgtaaacatctgctttaaagacgggatgtttctttccgcctgttcatcctcaaataaatagtgaaggacggccatgaggtcatgcgccccgctttctcccacgatgcctaattccgataaaagaaattttcctgtttctttgattgatttctcgtgcatcccccccggcccgctttttttcggctcattccgctgaataagacggcttaacgagtgttggatgtcgccgatcgaggtttccagttcaatccgctcttttacttttcccaaaacggtgacgatctcgattttgttgatcggtttgtggataaagtattcgatgccgagagaataagcttctcccaccatttcctttgcctccacctgcgatatcatcaccgcttttccgttgtacgatccctgaagatgccggatcgtctcaatcccgtcccgacccggcatcagcagatcaattaataaaatatcgacttgtttaaaatggagataatgcccttcaatctggcttccgtcctctgcctcaccgacgacttctcctaagtcctcgtcctcgatcatctgttttaaaatggaacggatcgcccggtcatcatcagctataaaaaaacgcatattatgagttcatcctttctgcaatcaaatgcttcaccggcagtttaatcgtaaatatgacgccttttggcttgttatgaaaggaaatgtctccgtcaagttcagttacgatttccttcacgtaagtaagcccgatgcccgttgaaggtgtgccgaattcatcgtatttggacgtaaacccgggatcataaacgacctctccgattttttccggaatgccgggaccgtcatcttccgcctgaaattcagccttttctccttccgtcctgcgcagcgcgaggcggatctcacccctgtctcccatggcttcgacggcattggcggtcaggttatttaagatcgacaggacggtaaagacgtgataatcgggatgctctccttcaatcacgctccggaattgaatgtccttgcctaaagattcggcgtatttttcattgattcggatgacgatgccgaccagagcggcggcattcatgtaatcccggaatctctcattggaaatcagcttcgacaggccggcgaatattcgctgattgtcttttttcacttcatgaatctctcccgcaaggcgcagcattcggctcccgagctcccggtcgttcccgctcatttcccgatatagctgataggattctttcgtcacatgctccgtcgttttcagcgtttttttcaaatgaatcgtttcttcatataagttggacacaatcatcagcatgtgctcatgctgctttctcgtttgtttttccctgacctgagattcgtgcagcttcatcacgttgaaaaaactcagcacaataaatgtgtgagaaacagcgataaccgcaatatccgccagcttgtccggcatcataatctgccggccgccggaaaactgaaccgtcatttcaacggcatcggacgcaatttcaatgagaaaaccgagaaacccgatcatcagcggccgatcccaaaaaagcctgaccttcagcacataaaacaagcaggcatatgtaaagtaaaaaaagaaactgggatattggctgaaaaaagcctccgcaaagccggcatgctctcctccccagcacgccaggccgatccggaatgccacaacggctgcacctgtcaacagccctgacaatactgccggcacatgccgaagcagcagcagaaaaaagaaaaaagccggggcgccgaagctgatccgatatacctcattcagagggtaaaatttcagttcccccgccagcggcacggtgatcagcataagggcgaaaagatagccgtcttttttcagtaaatagtcgagcctgatcataatcacttccttcttctgtctattttgaacaagaccgatacagtccgcaaatttctttagacccgaatggcgggacactccggctgatttataaatctatcggcttattttaagaatgattttgtcgtattttgtatgattctgtagatgtcattatacattaacatggaacacgctatttttgaaaacgttttccaagaccggtttccgcttcggacaggcttgcaatagaggaggaatgttatgaaagatatggtcagagagcgccttgaaaaagaggaactggcttcacttttacaagattgggtcgagcattaccgaccgttttccgtcaatggaaaaagcgcaaattatatacccgccctcggagaaatcaacgactctcagctgggcatttgcatattagagccggatggctcaatgattcatgccggtgaatggaatgtcccgttcacattgcagagcatctcaaaagtcataagctttattgccgcctgcatgaacagaggcatttcttacgtgctggatcgtgtggacgtggaaccgacgggtgatgcgtttaattctatcatccggcttgaaatccataaacccgggaagcccttcaacccgatgatcaatgccggcgccattaccgtcgcctcgctgcttccgggtgaaacggcgcatgataaattagaatatctcttttccgtttttgaaaaattaataggaaaacggcctcacattcacgaggaggtcttccgttctgaatggcagaccgcgcatcggaacagagcgctcgcctactatttaaaagaaacgaactttctcgaggcggatgtggaagaaacgcttgaagtgtatttaaagcagtgcgccatggagggtacaaccgaggacatcgctttaatcggattgatacttgcgcatgacggctaccatccgatccgacgggaacaggtcattccgaaagatgtcgcaaaactcgccaaagccctgatgctgacgtgcggaatgtacaatgcgtcaggcaaatatgcggctttcgtcggcgtcccggccaaaagcggggtatccggcggcattatggcattggttcccccaagcgccagaagagaacagccttttcataacggctgcggcatcggcatttacggtccggccattgatgaatacggcaacagcctgaccggcggcatgctgctgaaacatatcgcacaggagtgggagctcagtattttttaatcaaacgaaccaagaggtgattggatgcaggaattccttgaaaatgtaatcggctcggcaaatgattttttatggtcaaaactgttaatcgtactgcttctttctctgggactgttttttacgttcagatcaaagggtctgcaagtccgcatgctgaaggaaatgatccgggttttgaaggaaggcgcggccgcccggacaaaaaacaccatttccccgtttcaggcattttgcatcagtatggcggcgcgtgtcggaaccgggaatattaccggaatcgccattgcgatcgcactcggcggtccgggcgctattttctggatgtggattatcgcagtcatcggttcggcttcaagctttgttgaaagcacgctggcccaaatttataaagtaaaagatcaaaacggattccgcggaggcccggcctattacatggaaaagggcctgaagaaacgctggatgggcgcgctgttcgccgtattaatcacactgtcattcggggttgtttttaattccgttcaatccaatacgatcagcgtcgcctttcaaaacgcattcggcaccagccggcttacattgggcattattttaatcgtggttttcggcggcgtaatcttcggcggcgtcaaacgaattgcgaaaatggcggaatacatcgtagtcgtcttggccgttttatatatcggtgtcgctttctttgtcattctgacgaacatcacccaattgcccggcgttctgtcgctaatcgtaaaaaatgcgttcggcattgatcaggcagcgggcggcgctttaggtgcggccttgatgcaaggtgtaagacgcgggattttctcaaatgaagcgggtatgggaagcgctccgaacgcggcggcgacagctacgacgagccacccggtgaaacaggggctcattcaggcattcggcgtcctgacggatacgctcgtcatttgtacaagcacggcgcttatcattttattttcagacgcgtatcaccagccgggactgagcggcatcgcgctttctcaggccgccttgagcgatcatgtcggcgcatgggcgtcaggtttccttgccgtcttaatgcttttgttcggcttcagcgctctgatgggcaactattattacggagaaaccaatatcggatttttaagccagaacaaaaaatggctgttcatttaccgcatctgcgtgctcggaatggtactgttcggctgtatttccaaagtccagcttgtgtgggatatggctgacttgttcatgggcttaatggtggtcgtgaacttaatcgcgattttccttctgtcgaaaaaagcgtttgccgctttgagcgattatgtccggcaaaagaaagccggaaaggaccccgtcttttacagagatgtactccctgatgatgacgggatcgactgctgggagtattcagacatcgcgaaaagtgcgaaaggcaaacacatttcctaaacaaaaggtgttcgggcagcgtcctgaacaccttttttctgccggttcattgacaaagagaatagcgtccattaccctttttatatattttcagtaaagtcagaaaggaaggcctatgaatcccattacacaaatattaaatgaatacccggttatgatcatagacggcgcgatggcaaccgagcttgagcggatgggctgtgatttacatgatgatctgtggtcggccaaaattcttttggagagaccagaactgatcaaacaggtgcatgcagaatattttgccgccggcgctgattgcgcgatcaccgccagttatcaatcgacaatcgaaggatttgcagcgcgcggcatcccggaaaccgatgcgatacgtctcattcagacatctgttgaacttgccgcacaagcacgcgatgaattttgggcgcatgaagaaaaccgtttacaccggcccaaacctttggtcgccgcttctatcgggccttacggcgcgagcctcgctgacggctcagaatatcgcgggcattacggactgacggaggatgagctgatcagctttcaccgcccccggatgaaagccctcatagaatccggcgccgatcttttggcctgtgagaccattccgtgcctgtcagaagcaaaagcgatcacaaggctgctggaggaattccccggcacttatgcatggatcagcttcagcgccaaagacgggcggcatatcagcgaaggcacgcctatttccgaatgcgcggccctgcttgactcctgcagccaaatcgcagcgatcggcatcaactgcacaccgatcgaacatattccgccgctgatagaagaaatcaaacgggcagcatccaaaccgattatcgcctatccgaactccggtgaacaatatgacccggtgacaaaaacctggaaaggcgcagcgtgcgaaaaccatttcggaaaaagcgcgcaaagctggtacgaaaacggcgtgagcctgatcggaggctgctgccggacgaaacccgcggacatccaagccattgccgattgggccaagaccttaaaaacaacttgactaatcggaatagtttgtatattctattcaaaaagccggttcgccggaatctcgtgccgttcgccggcatgagattttttattagaacggctctcgcagaaagttggaaaacaatgaacaacaagaacgagacgaattttcagagaagtatgaaaagcagacacctctttatgctatcactcggaggtgtgatcggaacggggctgtttttaagctctgggtataccattcatcaggcgggtccggcgggcaccattttcgcttaccttttgggcgcgggcatcgtctatcttgtcatgctttgcctcggtgaactgtcagtggccatgccggtgacgggcgcattccacacctatgcgaagacctatatcgggcccgcgacgggctttacggtcgcatggctgtactggctgacgtgggcggtggcgctgggctctgaattcacggcggccgggcttttcatgcagcgctggttcccgcatacttcagtttggatgtggagtgcggtattcgctcttttcatctttttattaaacgccttctccgtgaaattttttgctgaatcggagttttggttctcaagcattaaagtcttagccatcttactgtttattttattgggcggagcggcgatgttcggcatcgtcccgatgaaaagcggtgaggccgcacctatgctgtcgaactttacggatggcggcagcctttttccaaatggctttttcccgatactgatgacgatgctttcagtaaacttcgctttttcagggacggaattgatcggaatcgccgcaggggaaagcgccgatccggaaaaaaccgttccgcgcgccattaagactacagtctggcggctggcgcttttctttatcggaacgatttttgtgctgtcagggatgatctccatcaaggaagccggtgtgattgaaagcccgttcgtcacggtatttgacagagtcggcgtgccttatgcggccgatctgatgaatttcgtcattttaacggcgcttctgtctgcggccaattcagggctgtacgcgtcatcacgcatgctgtggtccctgtctaaagaaggggagcttcatcccgcctttgccaggctgacctctaaaggcattccttttaacgctctgatcttcagtatgatcggcggcattctgtcgttgttgtcaagcgtatttgcagcggatacagtctatcttgttctcgtctccgtctcaggatttgcggtagtggctgtgtggatgagcatcgccgcatcgcaatttttgttccgaagacggtttcttacagaagggcaccagctttcagacttgaaatacaggacgccgggatatccggccgtaccgatagcggcctttctcctatgcctcgcctcctgtatcggcatcgcttttgatccgaaccaggccatcgccctttattgcggaattgcatttatggccgtttgctacaccgcttattacttgaaaaaccggaaaagcagagcccgcgtgcaagccgtaaaatcccaataaccaaaaaaagaaccctgcagcgcaagggttcttttttcatttatacttcaaccacccatctgaacgaatcccgcaccttcccgacttggatgccggcaatcgtttcatagagcctttctgacacttcaccgatcaaaccgttattcagttcaatcgttgctccgtgaatgtgcagcgcgccgaccggcgagatgacggccgcggttcctgtaccgaatacctctgacacctcgcctctcatcgcagcctcatagatgtcatcaatggcgacctgttcttccctgacgcggatgccccagctttttaacagctctatcacagatgcgcgtgtgatgcccccgagaatgcttccgtttaacgccggcgttacggcctctccgtttatgatgaaaaagatattcatactccctacctcttcggcatatttcttttccaccccatcgagccaaagcacctgatcataccccagttcttcggctttccgctgagcctgtaagctggccgcataatttccggacgttttgacgtcgcccactccgccggtgacggcacgcacatactcatcctccacataaatccggatcggtttcagctgatcgccgtaatacgaaccgacaggcgtcagaacaaccatgaacttgtaacgctttgacggccggacgcctaaagaaggctcagtcgcaattacaaacggacggatatataaagaggttcctttttctatcggtatccattcctgctccagctccaccaattgtatcaatgcctccagcgccagcttctcgtcaagaggcggcatgctcatccgccgtaacgatttattcagccgttttatattttggtcaggacggaacatcaacacccgtccgtcttctgacctgtaagccttcagcccttcaaatacggcctgcccgtaatggaaaaccgatgcggaagggtcaaggcggaccggttcataaggggtgattctcggatcatgccaccctctctcctcttcgtaatccatgacaaacatgtaatcagtgaagtacttgccaaaccccaatgaagcggagtccggtttttcttttcttgctgtgaccttacgtctttcaatcagttgattcaacaaaagcacacctttcttttaattgttcaaattttcagtcttttataagctgcctgttttctctgcctgaatcgtgtatgcacagatatatgaggatgcagttgaccgtatcatatcaaatataccacttataagaggataattatcaaaatttttgatattttcaagcgaaaatctaactttattttattctgcttgatttttttcaatgaggactttctgtcatattaaatgattgcgcttacataatgtaaagcaatcctttctttcgcacagtcaataatgtgacaaatttatggcgaataggaaggtggttgccgcctgcttcacgaattacgtatgaaatgcgcaagtaaaagggggattcgcttgaaaaaatttatcgcattccagattttgatcgctttagccatcggagcattgatcggccacttcttcccggatttcgggatggcgctgcggcccgtcggagacggatttatccgcctgattaaaatgattgtcgtgccgatcgtgttttcgaccattgttatcggagccgccggcagcggcagtatgaaaaagatgggcagtctcggcatcaaaacgattatttggtttgaagtgattacgacgcttgttctggcgctcggtctgttattggcgaacgtgctgaagccgggagtcggacttaacctctctcatcttgctaaaaaagatattcacgagctttccggctatacggaaaaagtagtcgacctgaaacaaatgcttcttgatattatccccgttaacatcattgacgtcatggcgaaaaacgatcttctcgccgtcatttttttcgcgattttattcggtgttgccgcagccggcatcggcaaagcctccgcacctgtcatgagtttcttcgaatccacggcaaatattatgttcaagctgacgcaaatggtaatggtcaccgctccgatcggcgttctcgccctgatggccgcctctgtcgggcaattcggaatcgcgcttttgcttccgatgctgaagctgatcggcactgtgttcctcgggctgttcctgatactcttcgttctgtttccgatcgtggggcttatctttaaaatcaaatactttgaagtgctgaaaatgatttgggatctgtttttgatcgctttctccacgacaagcacagaaaccattctgcctcagctgatggatcggatggagaaatacggctgtccgaagcgggtcgtctcctttgtggttccgtcaggtttatcgctgaactgtgacggctcaagcctctatttatcggtgtcctgtatttttctggcgcaggcgtttcatgtggagatgccgctttctcagcagcttctgatgatgcttgtgctcgtcatgacaagcaaaggcattgccgccgtcccgtcaggctcactcgtcgtgcttctggcgacagcgaatgccgtcggtctccccgcggaaggcgtcgccatcattgccggtgtcgaccgcgtcatggacatggcgagaaccggcgttaacgtgcccggccatgcggtcgcctgcatcgtcgtgtccaagtgggaaaaagcattcaaatataaaggacccgtcacggcagaccagaccgcccggacagaaagtatgtaaacacaaaaaagaccaccttattggtggtcttttctattaatcaatcgccgcatgatcctcttgttcaatcaaagcaaggcgttcattgatttcttcctgagtcatttcgtgctctttcacatacatgttgcgttcgttcgtacggcattcgtgactgcagctgcgcatgtatttgtattcattctcaggtgtgcagatcatttttttattacatgccggatttgcgcagttcacataacgctcgcacggctcgcccgtgaaataatcttttccgatgataacgtgctctacacggttgaccggtacgctgattctttcgtcaaacacgtagcactgtccgtcccacagttgccctttcacttcaggatctttaccgtaagtgacgataccgccgtcaagctgggacacgtcttcaaagcccttcttcagcagccagccggaaaatttttcacagcgtacgccgcctgtgcagtacgtgaggatttttttgccttcaagcatgtctttatgctcttcaatccagtccggcagctcacggaacgcctcaatatcaggtctgaccgctccgcggaaatgaccgaggtcatactcatagtcgtttctggcgtcgatcacgatcgtgtcaggatcctgcatttgctcataaaagtctttcggtttcaaatgcttgcccgtcgtgacattcggatcaacatcatcttcgagacgaagcgtcaccaattcttttttatggcgcacaaacattttgcggaatgcatgtccgtcagcctcgtcaattttgatcggcatgtcggcaaagcgcggatcagctttcagtgcattcatgtattgatccgtctgttcaaccgttccggacaccgtaccgttaatgccttcctcagaaatcaaaatacggcctaacagaccgagctccttacaaaacttcaaatgctgagccgtgaactcctcaggctcatcaatctttacatatttataataaagtaaaactctatattgtttttccatgatttatacaccctgttcaattatattaatgatcgcacactctactatatcatacaggaaaacgggcgaaagatgaacatttccgtccgtactctttcttccagtcacgcttcgccttttaaaacctgctgaaaataaaaccgatacgtattgcgcaaaaaggtctcaagcgaaaggccggccgcggtctgatacttgccgataataaacggaaaacggtcacggccttttgcccgcaaaagatcggcgctgtcttcagccagttctgagatgagcgcctcaacgacaggccggcatgcgtcccgcacggcttcaagaatttgctgatcccctgtatgctggtactgttctatcagctttgccaaatccttttcttccataatgttcacttccttacaccatataaaaaagaggagcagcttttataaagcggacgcctcctcctgtgactccgcataaccgatgatctgaccgacctgtaattcacggccttcagtcaggttatccgaaggggtaaacatatctttctcgaatactaaaataacggtcgatccaaatgaaaaatagcccagctcttcccccgtctcaagcctgtttccggtgtttgtctgaacgatcgagttaatattcatcgcacctaccggaatcatgagcatctgctggtcagcacgggtcagctcgtacacataacggtaattttttgagagcacgtctttcccgtactttaaccccatcgtattaacgggataggagcgtttccccagctcggccagcttctgatacgtgcagctgacaggagaatggaagcggtggtaatgtctcgggctcaggtaaagcacggcaaaacacccgccgttatacttgtgatcggcgcttttaaaccccgtcagttcggcgaacgaataatccttcccttttaccatgaaagtttgattgggtttaatcatgccaaccgtctgaacgacaccgtccaccgggctgacgatggcgttcttctcttttgccacggggcggagatttaaattaatatcacgaatgaaaaatgacgccaatgaatcaaagtcagaagccgtgcgttccgtttcattccagttgatgcgatagtgtttggaaaacagcggaatcatcggcttgctcagtttcgattcacagaagtttttaatgagataagacgtcaatcgattattagtcagttcaatcaatgaacggtaaagaactttagcggcagtattaaacattgattactcctatgaattttcctatagtaataaaaataaaacaccataaaaacgctccgatggcggcgaagcataagtaggttttgaattccattctgccgattccggaaaagtagcaggtcacgtgtctgatgccggggatgaaataacctaaaataatggtgtacggcccgtacttcttcatccacctgtctactttctccatcctcttttccttcaggccgacccatttcccgaacttattaataaacggccggccggcttttctgccgatgaagtagctgataatcatcccaaggagcgctccgataaagctgatcagaatggagagcccgtaattcagcacgtttaaatgagcgaagtagcccacaagcgtcatcatgacttcatccggaataggcaatccgataataccgagtgtcagcataagaaaaatcgcgatatatccgtaatcggatattaattgctgaactaattccatcttctgctctccaggttttcaggcgcctgttttttaaagtgcggaaatttaatgttgctgaccattaaataaccgagcgcgatcgttcccgcccccagaagaaaagcgttattgataaagctcaaaatgacaagacacatacccgcaaacggaatcggcatcccgataaacgtcggcagcttgctttgttcaatattaaatctcgaaagacggatcatcccgcagatgctgtaggaaagcgcgattaaaattccgatgaacggaatcgtatatagtgaaacactgtaagcgagcatggacggcgctacgccgaacgtcacgagatcagcaaaagagtcaagctcccttcccatctccgataccgcgttcagcttacgggcggccaaaccatcaaagaaatcaagaaacatcccggtgaaaataaagatcaccgcagagtgtatattatgatacaaaagggaatgaatcgataagagcccgcaaataaaatttccaattgtaatcatactaggtatataattcacagtttacacaaacctccaattaaaaccatatcaaatcggactgcgtatgcataaaggctccattttacggaaacataaaatgaaattctttcaatgctatcattcaaattcttttattatacagcatttggtgttatttgaacaatctaatctggtgatttttgttttttcgccgttcatattaaggtaagcaatcatggattcctctattccggattaccctgcttcaatattccatgccgcgatccggattgtccgttcttgatgaatgaaaagccgtatgatgtattgttatttccttctccgtgaaatgagaacattacatataacgattgcggacataaaaagtttcatgaattaaaaagccggcacaaaacggcctcatacattatctcacaaccccgttttccagtatatagtctgccaaacaaaaaaggcgccttaccattacggtaaaaacgccttttaagatcattttatgtaattgataaatgactgagtgcttcggccgctctttctctggcttcttcaacggtctcagctgcagaaagcgcaaccgccatacggcgtccaactttcgtgacgggtttaccgaatacgcggacctgagtgctttttacccccaaagccttctccaaaccttcaaccgcataatcagcaagctcttttggcgccttcagcggacggcttgcccccggcgacagctgagtgatttccggaatcgggaatcccaataccgcgcggacatgcagcgcaaactctgacaaattttgcgttacaagcgtaacgagccccgtatcatgcggacggggagacacctcgctgaaatatactttatcttcagtaaggaaaagctccacaccgaacaaaccgtatccgccgagctcgtccgttatgcttttcgcaatgtgtttcgcctctttgatctgctgttccgtcatatgatgaggctgccatgattcaatatagtcaccgtctttttgttcatgtccgatcggcgcgcaaaaggacgtaccgttcgccgcgcgcactgtcaaaagagtgatttctgactcaaatggaatgaattcctcaacgatgacccggccgtttttcacccggccgccttccatcgccatgtcccagcagcttttcagcccggaagccgagcggcacacgctttgcccttttccggaagagctcatcagcggttttaccacgcacggaaagccgattgtttccgccgcttctttaaattcttcatatgtattcgcgaattcatagccggcagtcggaagatgaagcgtctctgccgcaagccgtctgatgccttcacggtccatcgtcagctttgccgcacgcgcattcggaatgacgtgaaaaccttcttcctcaagcttcagcagctcatccgtcgcaatggcttccacttccggcacgatcaagtccggtttttctttctcaatgacttctctgacctgcgctttatcaagcatatcaatcacatagcttttgtgcgcggcctgcatggcgggagcatgctcatagctgtcaacggctacagtgacaaccccgagccgctgcgcttcaatgacgacttctttccccagctcgcctgatcctaataacaacatcttcttcgcctgatacatgtcctttggccctccctttctataccccactcattataacggaaatattcaaaaaataaagacaagatagataacaagctctatcctgtcttttgcgctgattcgagcgattcaatcgcagctgacacgtccttctcgcgatattgccccattaagcataacgattcttccgcccggcaggcgtgagaagcaatgcggcgcttggcttcctcatggttgtcaaggatgccgagatcacagagactgacggggaaaccgagccggcggtaaaacggaagcagctcttcaatctcaggtcttcgattctcaagcgcgagctgcaccaatatgccgtaagcaaccttctggccatgcagcacctgatgtgtctcctgaagaaaactgagtccgttgtggaccgcatgcgcccctgccatcctgcacaaacggccgccatacccgccgaccgtccccgcaagcataatgatcgtttccgccgtatggatgaacggcacggacagctcgcctttctccatgcttccgacggccgcttcactgtaacgcaataacagattacggatatattccgcctgtctcagccccgcctgcgccatcagcggcgccgcctcctccgtatttctgatgaccgcctcggcctcataccatttcgccagcgtatcaccgatcccgcttttcatatattcaatgggagaggaaagcaaaaacagcggatcaacaagcgtcaaatagcttgaacgcttatgataatcaactctgataaaattgccgctctcatcatatatgacactcaacggcgtacttgccgcacacgtccccgcaatggaaggaaccatcacagcttcaatatcaagccggtctgccgccgcttttgccaaatccaaaatcgtgccgcctccgataccgatgatcacatccgcgtctgccgcctgctcacagaccttacgcaccgcctcaggtgaacagtatcctttatgctgaatcacatcccaggaagaaccgccgctgtaatcggagaacgcctgataggatttgattccggtcacaataacgggttttctgaatgtctccagcagccccggaagttcttttgcgattccttccttgcatatgtactgattcgggccgcttcggacgatatcttcaggcttcattcgaatctctcctttggctggaatttatatatattttcccacttgtcagaaaatacatcaaccggaggtgcgtcagcgcttcgcttcttccgcctccaaaaacagctcatcaagccgctccaaagcttctgccttttcaaaactgctgaaccacagatcatcataggaatcaaggatgcggtaatggtgggaaatcaaatgctgctgcaagcggaactcgccttttttctcgatggctttccaccacaccttgccgcccatcgtcttccccttcggcctgtcaattgtgcggtgagcaaccgtttcaatgacttccagcggatcatctcctaatacggattgcagtgtttcacttgatctgaaaagcgcgcaaaccgccacaacgtgcggccattccgcaagcgcccgccctttctcaatctgcaccagcgactttttagaaaggccgatcacatccgccattttctcctgtgtgtagcctctctccgaccggattttcttcagctggactgagacaagctcagtcatataatcttgatccatctcaacctccatatttatcaatatagccattttacaccgcggcacgccttttttatatcagaacattttcaaacgaatcaaaagaacccgggattggcttatcattgaagcgatgtacctttccgcataatccagaatgatgcggtgaaatacaaacgtacgcccgaagagacaggtgcaggctccctggcggttgagctccggacaaaataaaaagctgccgcagctgcagcagctaaaactttatagaccggaagatcagcattatgaagcgaatacaatccatcttgcactataattgacacgttttttcgaaccctgattgaccattttaaatctgtatgaatcccctttttttaacgaaggtgtttcaaaataagtcgtaccatttttctttgcattggcggttttgattgttttccaggcacctttgccgttgacttgcttttggacgtatattttatacgtgcccttccctttactgttggatttaaaagtcacggctctcaaggtgtacttttttgtcgttttagtgaatttagggtgatatgtattgatcacatagttagtgaaatacccgcttttataagtatgaagccagtctttagcctctgctttttgcggagaagaaaaacccataaaaccaattccgctgattaaaagagtaaaaataatgatgagcgacttaaaaatctttttgcttttcatcgagaaaatccttccttcctgtaactatttaccctatttatgttaatgacaatatagccaatcataaatccgtccaactaaccattttgaccgcaggaagagatgtgaacagcccttaaaatgactatatgactactacttatgattcttgtcatttttgattaagtgataaagttactttaaaccgctattcattttgttgtttttgtatcaattgtcatagcgaggtcttttcctatcaatgcctctctttcggcgtttgttctgctgccgtgatggggctctccttggataaacccctgcacccatgacaaactgtcatacgtttgccacctatgaatgaacgcacaatacacataatggagggattgcaatggacgaaatggtcctggaaacacaacaatggctgaatgagacgtacaaaggcagacacgggtacaacaaagtgccggaaaacggaaaaacgggctgggataccatttacggtctgacacgggcgcttcaaattgagcttggtatttcagaacctgccgataacttcggaccgacgacacaaagattgtttaagccgttgaaaaagcaggctcccgattctaagccgacaaacatgaattacattctgcaaggggcgctgtggtgtaaaggttttaaccccggcggattttcaggcgttttctatgaaaataccgaaagcgctgtaaaagagtttcaaaaagcggccgggctcactaagcaagacggcatcgtcacggcactcattatgaaagccttgctggatatgagcgcttttcgattagtagcgggaggcgacaaaagaatccgccaaatccagcagaacctgaaccgggattacaatgactacatcggcttgatgccttgtgacggcttatatgcccgcgatacaaacaaggctctcatttatgccctgcaaaaagaagaaggcatgagcacaagcgtcgccaatggatttttcggaaacgggacgaccagcttatgccctaccttgactcccggcgattcacggacaggctttgttttgattgtccaatacgcgctttactgtaatggggaagcgtttgatcccggtgaattcgacggaaaatacggcgtcggcgttgtatcggcagtgaaagctttccaaaagtttatgtgcctgccgcagaccggttatgcggacatgccgacgattaaagctttattatcaagctccggcgacacaacgcgggctgcttcagcttgtgacaccgctgccattttgacggcagatacggccaaaactttgcgtgagaatggctataagatcgtgggaagatatctgaccgggaatgtgcggacaagcagcggactgacatcgaaagcgttaacgtcaaaagaactttccacgattttcaatgccggcttaagcgtgtttccgatttatcaggacggcggctatgaatcttcttattttgtaaaagaccaaggaacgagagatgcgtacagcgctgcatcagccgcccgaagattaggttttccgtcaggaacgaccatttactttgcggtcgattttgatgcgtatgattatgaagtcacggataaaatcattccttacttccaagaaatcaagtcagcttttatgaaaatgcaggcgttctctactgcgccgaaatatgaaatcggggtatacggaccgagaaacatttgtatccggacgtcagaagcaggtctgaccaaatatagctttacggctaacatgtcgaccggattcagcggcaacctcggatacccgatgccgaaaaactgggcttttgatcaattttatgaagggacaatcggaagcggagcgggaaaagtcgccattgacaaagacggatactccggaaaagactcgggtgcaagcagcgtccatccgccttctgatcctgtgtatgatgcaagactgcgcacgctgacggatattttaacaaccattcctgctttagaaaatatatcgaatcttgcgaatgccatgtttgaattcgacaagacagaaaccatttatgcatcacctgaaatggatattcttttatctacttcacttttggcaacagttccaagcgaaggttctcccaacacagttaccattacaaatggcaaaccgggagcctatattaccggtctgatgggagattcacaagtctcttttacagcatcacaaattgattcctatcaaaacctgcttaacagtctgagcttgtcagtccgcaacggttatttagaagtgtatgtcaatccggctgcgggatcgctgaatattcaatttaaaatttatacacctgatattccggtcggtgacagtgctacaactggactaacaactaccattacatttaaaataaaacaaaagagcttcaggttgccggattccgaagaagtgtactctccggattgggattctgtcgtgaataccatggctattgcaggcgcaggaattattgttattgtagggatcggtgctttagtcgttttagcacctgaattaggaggagctgcagccttgttcagcacggttttatcactatttctataattgaacaggcagctccttgctccaggaatgctcaatgagtattcttggagttatttctaaaggaggattcgcatgaagattgatatgcagacatacaaggaaaccgttcaaaaaatagaaaccgatttgattccgcgaagtcaaaatgacgaagaactgcttacatacttaatgaaacaagattcgctcacactgaatcaaatgaaaatgtgtctcactgaaccgcccctcaccttccaacatactgtcaaaatcgtatgtacagtcacattcatcacgttatatatcttttttttcagcactcattttaatgatttgattgaaatggctctgcagatggttttcggcctggccggccttgtttggattattgctgtatttccgttttcaagaaaaatccaagtgtctgaccgtttcagacaaaaatctgaaaacacccgtatcaccggaatgatagactttgtcctcgaacaacgatacaaagacatgatcagttaaaacccctctgcttaaggggttttttattatgcaatcccttcaccccccttatcaaaaaaggctcttctcctttggaaataaccggaacacccaatttcgttttcaatataatgaggtagtggatccgcaaagaaagaagggcgacatgatgggtatcattaatggcaaaatgttcattgaccgattaaatcagcttggaaatgagatttggcttgatggtgaaaagatcgagggacagatttctgagcatcccgcatttaagggccttctggaaacgaagcgctctctttatgatttgcaaacgaaaccggatatgaaagatcaaatgacttacagtcttcccggtaaaaaagaacgggccgggctttcatacctgcagccgaaaacgaaagaagacgtaaaaagaagaagaaacatgttcgaacattgggccagacacacgcacggaatgatgggacgaagcccggattatatgaataccgtgctgatgagcttcgcctcctccgccgcgcttttgaaagaccgcgagcattgttttccggaacatgttcaagcgctgtacgaacgcgctgctgcacaggatctttcttttacgcacacgtttatcacccctcaggtgaatcgttcacaaatgggtgtaaacgtatcgccgacacctatctcggcaaaagtcgtcgataaaaatgaaaaaggcctcatcatacacggcgcccggattttagccacacaaggcggcctgacggatgaagtgctcgtggtttctctgcctaaaatgtattttgaatcggatgaagcgttcgctttttcaatcccttccaatacaaagggagtaaaattcatctgcagggaatctttcgtactcggcaaatcatcgtttgattatccgctcagctcaagatatgaagaaatggattctatcgttgtatttgatcacgttttggtcccttgggaacgcgtatttttttataataattacgaggcggcttttgattttaatatgaaaagctcttttaacgccttcgcatttcatcaagtcatcacgagacaaattgtaaagacggagtttctcctgggcctcgcccaaacgcttgtcgaagcgatagatgtgggcgaatatcagcatattcaggctaagatggctgaaatcatcaccggtctggaaacgatgaaagcccttttggaaaagtcggagaatgatgcggaaacagatgaatggggttatatgcgtccgagtgtcactccgcttcgtgtggtcagcgcgatttttcccgacatctacccgcgcttcacggaaatcattcagctgatcggggcaagcggaatggtgactttgccgactgaaaaagcgttccgttctgacatcagaggagaccttgaccaatatttgcaggcggccgaattgaacgctgaggaccgggtaaaagtgttccgcctcgcatgggatttgaccatgagccccttcggaacaagacagacacaatatgagcggtacttcttcggtgaccccgtccgcttaaccagccatctgtacagaagctatccaaaagaagaacagaccgcggtcatcaaggaattcctgcacattcataaataaaacaaagcagagagcgcatctctgcttatgatagctggatcggctgccgccgatcctattttttattttggctgatcaccaccatcgtaatatgcgataacgcgaaagagacaagcgtatacacaacggcccacccgataaacgagaaattcaatacggtaaaggtgcatataaggcaaacggccaaagcggcagccggcataatgaacgcgtttttaaacaggtacgttccggcgactgacaagatgatgatacaaagcggcagaacaccgaacgcaaaatccaattcatcaatcaacagatgcactcccttcgcttttcttagtccggcctaacacatcttatgcctgagtacaaaatcgagtacttcaaatctttcgcgctccggctgattttccctccggttatttattcaaaaaaatgaaaactttccttaaagcgtttacattcacgtcagactgtgataatttaagaaagcgctatcatacacaagttaatgatttttggatggagatgaggagaaccaggaaaccccgccctttcacaagggtgatttctggttctttttgtcattttcaaggaaaggagtcatacatacatcatgatagacgttcagcaaaggggaggatatgatgtttcaattgtttaagccggctccgcatattgagagattggatgattcaaagacggatgcggcctataaacggctcaggctgcaagtatttttggggattttcatcgggtatgccgggtattatttgcttcgcaaaaactttgccttcgctattccttattttcaggaacaagggttttcaaaaggggaacttggcttggtgcttgcggccgtatcaatcgcttacggcttcagtaaatttattatggggatggtgtctgaccgctgcaacccgagatatttccttgcgacaggtctgtttttgtcaggtgtcgtaaacattttatttgtttccatgccgtgggtcacgtcaagcgtgacgattatgtttatttttatgtttattaacggatggtttcaaggaatgggctggccgccttgcggacggacgatggctcattggttttccatcagtgaacgcggaacgaaaatgtcgatatggaatgtcgcccataacataggcggaggtattctcgccccgctcgtgactctcggcatcgccatgtttgttacttggaaaagcgtgtttttctttccggcgattatcgccatcgtcatttcatttgtgattgttcttctcgttcgggacacgccgcaatcctgcgggcttccgccgattgaagaataccggaatgactatccgaagcatgcgttcaaagaccaggaaaaagagatgacgaccaaagaaattcttttcaaatacgtgctgaataataagtttctgtggtatatcgcatttgccaatgtctttgtttatttcgtgcggtacggtgtcgttgactgggcgccgacttatttgacggaagcgaaagggttctctcctgaagattccagatggtcttatttcctttatgaatatgcgggaattccgggaacgattttgtgcggctggatcagcgaccggtttttcaaaagccgccgcgcgccggcaggcgtactgttcatggccggcgtatttatcgctgtattggtctactggcttaaccctgccggtcatccgctcatcgataatatcgcgctgatcagcattgggttcttaatctatggacctgtcatgctgatcgggcttcaggccattgaccttgcgcctaaaaaagcggcgggaacggcagccggcttaaccgggtttttcggctacatcggaggctctgctttcgccaacgccatcatgggttatgtcgtagaccgctttgactggaacggcggctttatcatgcttatctcctcatgcgtgctgtccatcgtcttcttggctatgacgtggaatacgggcaagcgggcggagcatgtgtaagaaaacaacataaaagattaatatttttgcagtacagcatttacaacgattttctacactagagacagatattgatttttaagggggaagaaaacatgcggaaacataaattgtttgctttggtattgctttcattcggtttattgtcattcatcgtcacgcctgtatcagcggcaggaaaaggaaacctcttgtctcctgacagaattttgaccattgcccatcgcggtgcttcgggatatgtcccggagcacacgatcctttcttatgaaactgcgcaaaaaatgaaggctgactatattgagctggatttacaaatgacaaaagacggcaagctgatcgtcatgcatgatgaaaaactggaccgcaccacaaacggacaaggctgggtgaaggatcatacattagccgagattcaaaagctcgacgccggctcttggttcaataaggcctatccggaaaaagcaaaaccgcaatacgccggacttcgcgttcccacacttgatgacgtgttaaaacggttcggcagacatgcaaactattatattgaaacaaaggcgcccgaaacatatccgggtatggaagaaaaactgatcgcttcactgaaaaaatacaaattggcaggtaagcatgcgaaacttggacaagttatcattcagtctttcagcagggacagccttctgaaaatcaaacagctcgatccgaaacttcccgctgtccaattgcttgaagcggaacagatgacgtcaatgactgacgcagatttaacggacattaaaacatatgccgtcggtatcggaccggattacaaagcgctgaacgctcaaaatgtccgaaacattcgcagccacggccttctgcttcatccttacaccgtaaacagcgaggcggacatgcgccgtctgctgaattggggcgtaaccggtgtgtttaccaactatgcggatatattccaaaaggttaaaaaagaatacaaatcataaagccacatgggttcggagatgatgccgagcccatgttttttgcccgataatgcaaacgccatcatgggttatgtagcgggcggagcatatattaaagcttacattcacctttatattaattaaaggtatcactgtaattgtgaattacctatgataccttacaaacaaaaggatataattatttatttctattatctattttctttcttatactatttgtaatagacgataatacaagtgatactaaaccatagacaaccacccatccccaaaaggatagattaaaaacagtaaacattagtatgacagaaacaactatactgacaagcggcattatatacacttttttgaaaatataagtgaatataatcgataagacgataatagaaagtggtaaaataccaaaagcaatatctagctcatccattattattctcctttgtgaatttaatttctccctttaaatatactcactcagctatctagcgatttaaaaaatgtatctatccactccatacttctttgtttttcttaatcataaaaaagtcatattcagaaacatgggtattgttaataattttttcaagtcctctgataggagtagattttaatttttttccgtttttataagagtaagaattaatcacatatttcccacccttgcttatttctaacaagaaaattttagattcgtcaaaataagtgaattttgcttggttttcaaattttgtcgacctatttaacggaatttttttcccggcttcatacttttcaaatcgaaagtataaagtattgaattagctgccaaatgatataaagtgtcatttttcacaaaaaagttattagtggaaagaggaattgccagttgagaaatttcatcagggatattataactgcctaaaggatatgcccctttaaactttttatgctctaaatcaatttctgctactttgaattgtactttgtttgatttatccgtttggttatatagtataaaaaaggctgagctttttttaactattatttgtgaataaacactccaattttcttcatttaatataggaattgttgttcctttccctactgtaactttatctttatctattttaataccctgaaaagtcggtgttttgattgaagaatcttcatttatcacgtaaatatattcaccgtcattaccagtacttgtatagaaacccggaataatcttttcatgaaatccactgccgttaccccatctaattaaactattataatggttttcaccgactccttgattattcaaaaaataaaagatattttcttttattaaatggcctgatgattgcccataacttgtatgtacttgatgctgcatcgggaattttttaaagttatcacctatcatataaacttcttttttgtcctgtctaactatgtttttttcatcttgtgcaatggttccaacctcaatagcatctccttttacagctgttgctgctcctttttcatcaatgtatacagtacaactcccatctttaggataatctattgtagctgaataatatatagctgcaattttatcattcaagaaatacttttccttttctttttcagtttgtttaacgtcagaaactgaattagtatatttaaaagttccaatacatataaatatacctattaatactatgaccgcaattataataagccacttaatcttgttcaaatataatctctctccttaaaataatatgactccctaaataaacttagggagtgaaaataattcatctaaatgttttaatagtttttgtataattggaatctctgatgtctcttggatagacgcccatgcctttatctttatccatatctataccagcctttagcttaaaagctgaccataatagttttgaacagtttttatcaccataatgactcgattttctatttgttgcaaaattatatgaataaccatccttcccaaccctgctataaccccaatttactgaattattttttttagaactagaaactttcacattttgaattacagcgtttttttcgaccttacgtttcgatgaagctattgcacgaacaccttttttagggaccgattcgacaatttgatttcccttatagtacataccgacatgtccatgcggaagcccaaaagtagatgcaggtgtatagtaaacattacctttagagcttgatcctataattttcggcccgctattcttgcccattgtgctcattctattacttttatcttcttctttatctagcttttcttgcttctttaattcagttttaatttcctctaagatctcattagatgttttattatcttgtttaactagatcattaacggattcaattaatttttttttcgacagattcggattcattttcaatatgtagtttactgtttctgaattatacgagtccacagccttaacacaaaatactaagggagtaacgatgcataatattgcaaaaaatttctgcattttcatacttattacctccaaccatttgtttattctcctatattttaatttattatacaattattgtaatcacaacttacgtactgtattttctctatggttaattatttgttttgtcgctaaaactttgacttgaagtacaggaaaacggatgaagttacggagaagaaagaagttgcccaacatatcttttacattcattgtttaatatggaagacagttattgataaggcggagaaatcatgagaaaaaaagaatactgtccttggttgcctgtcgttaggctttctcattcatcgtcacgtctgtatcgaacccatgttttttgcccgatcaaaaaaccttgcgggaacgttaccgcaaggtttttattaatcattactcttttccggcagcggcttccgcctgtccgccttttaattgatcgttgattgctttggcgtctttcaaatactcagtcttgaatccgctcttcagggcccacgcatagaaggcaagggcaacgattgcgatcagccccatatcccagccgtacggaatgatgttcagaccgccgaatttttcacttccgagccatgaaatgaccatcatgctgagcagatagacaaccatccagacgccgcctttaaagtttctgcggaatcctttccacttcgctttcgcttggtagtagaaataaatcggaaggccgatcaaaatgataaacagcacctgccctgttaacggccagcgcgcccaatacagcacgagagacgcgaacacgaagccgagcggtgcaaccacgctgaggcctttcagacggagaggccggtacaaatccgccgccgtccgccgcagcgtcatcaccgtcacgggacccgtgatataagaaatcagcgtcgcaacggaaatgatttcagcaagcacgccccatcctctgaataaaaacagaaagataaacgatacgaccaggttgaaaatcatcgcttggcgcggcacgccgtacagcggatgaagctttccgaaaatgctcggcatatatttatttttttccatgccgtaaatcatgcgtgacgtcgtagcggtataagtgatacccgttcctgacggagatacgaacgcatccgcataaagaataatgacaagccagttgatattcaatgcgatcgccaaatcggcaaatggagagttgaagttcaggtgactccagccgtgaacgatcatggaaggttcaaccgcaccgataaatgcgatttgcaataggacgtaaatgacggttgcgaccagcagcgaaccgacaaccgcaatcggaatcgatttgccgggattttttgcttctccggccatattaatcgggctttgaaacccgttaaacgcaaatacgatacctgatgtggccaccgccgtcagcacgctcgcccagccgttcggcgcaatgcttgaaccggatgtgaagtttccgccgtgaaaaccggtaaacagcagcgctccgattgtcagccccggaataatgattttaaagatggtaatcaatgaattcgcttttgaaaataagttaactgtccaataattcagtaaaaagtaaataatcagtaatacggatgcgaagccgagcccctctcccgtaagagtgccgttgtgaacgagattgcttgtccattttgcccattcccacggccatgagctcatgtattgaacagacgcaaccgcttccaccggaataacggaaacaatcgcaatccagtttgcccatcctgcgataaatccaataaatgatccatgagaatattgagtatattttaccattcccccggcttccgggaacattgaacccaattcactgtaagaaagtgcgataaacaaaataacgatcataccgataatccaggaaataattgcggcaggtcccgcaatctgagccgcccgccacgccccgaataaccagccggagccaatcatcgacccaagtccgaccatcatgagtgcaaacgttcccattctgcgatgtaattgattcataaagttaacacctttcaattaaaatatgactccagcgctatcatatatttataatattattctgaaaatagttttgtcaatctttatcgcattaaagcagaaagccaaaattacccttccgatgtttaaacagccgttaagcgggaataactactgcaagccagaaatagaaaggagtttttatcgtgaaacaaaaactgctcatttcaggacttgccgtgtcgactgtcggagtgacttcctacctgctcaaagataaatccaaccgccaaaaggtgatgaactttatccgcaatatgaaaacatcgctctccgggaagcaggatattgaatcattccccgtcaacaaagcaggcaacccgcatcccgaagatattgaagataacaaaatggtatccgaaggctccatgtacccggttcaatattatgatgacaagaagaaatagtctgttcccgggctgcccggccgtatcaaacggcggcagctttttttatgcagacggcgtttgatagatccgccaatattggcgcgatcctttctcccgcacggtaatgcccagtttggatatttccgctttcagctctttcgcatcagccttttcctcctctttcagcgccttttctctcgctttaaaaagagcatttgcccctggctccaaatccggcgtgtccggcacccaccgtttgtattcttctttaaaaggatcttccgtccccagccagacatacccatgcgcgcgaaacgcatcagccgctttttcaaccgcgggctcaagcttctcccgaaaaagctcctgcccttcagtccccaataagacaagatgcttttcatccgtaaacacaccggaaatgctgtctttcgaaaacacgctttcttcattatatatggttaaggacacctcgctgtccgtcacgaccgccgtaagacattctttaaaaacagtccgcgtcagccacattcccccgattaagccgataacggcggttgcagccgcagccttccatccgtgaaaagaagcgatcatttccagcggcccgataacaggcagccaatccaatgttacggcccacttcgcaatgaccggcagaaaccatccgatgaccagccccaataatggcggcatcagaaaaaccaaagctttttcaaccgatgacaactcaagaaccgtctgtttttttatttcgttcatgtttctcctccgtctgtgtttttcacaactatccattatacaaagggttggatgattctgtaaactgtttccgaaacaataaaaagcctcccggccgccgggaggctttttaaaacaggagctcatatacttcattcaattccatcgtgcgcttctcatcctgctcgttctcagcatatttgatttccttttcaagcacctgattcagcgcatccatttccagatcatttagatctttcacaaactcgccctcatttgcataatgcttcacctgaagctttttataaatcccccggcacacatcatgctccaagtggttcgaaagcgactcgcgcaaatatccgagtgtcctgtccatcatgtaagccctcccttttctttaagaatagcttcccggaaagagagaaaaactatacatgaaagcaccgggcggctgttttaactctgtacctgaatggagaaaaacccgctgcttaacggagtgtacggcccgttcagccccgttgcggagaaagagaatgttcctgaactgacataagaaagaggaacactgtaatatttaatatagcctgtaacgatattgccgtttttcgtatattcatcttccagcgcttttgacgtaagatttgtaatattcgttccgttgttaaacgcctggatcgtgttattgttcggatacccttggaaatatacggctaaataacccgttgtacccttcatcggttttgatgcgctgatttggttcggcccgatattttcccattggtaactctgaccgtcagacgtcacaccgataatacggatttgtgttaaagcaggagccggcgccgcagacgctgatggagcccacaacccgctcacaagcaacaaaacagcggcggccgccgcgaatagcataacgagtctctttttcatgtttcttccccctcttattcttttcgtagaatcctatactattttacacgatttacaaggaaaaagattacattttataaaagagtccggaacactttgtgaactagatatgaaacgctcttgaaacgccgttgatcatgagaaagatgccgcagattcttaacacgactctcgaacttctgtcatctttaccgaaaaaggtttttccgagccgcccgatccatacgttcattgcaactcccgcgagcaattctatgattccgatcatttctgccatatacaaagcagccacccttctaaccgttttttttcatatgacggcttatcatataaagtgataagaccaatgacgctgcaccgacagcaagaaacaggctcagcggcacgatctgcatgctgcctccgccattgttttgaaatgcgccgatcgcccatttttcaggagtaaacaacgacagcatgcgcatgtactccggagccgcgtctaatgtgaagaaagcccctcccaataaacccgtgacagctataaaaacggaagcaagcgacgtgaattgcttttggctcttcatgaacggtatcacggccatcgttacagcagtcagcgcaaacgagcaggccgcaagcaccgctcccgcagcaaaaacatgatcagcaaaacggatatgcagcatgaatgttccggcagcgaggatcacgataatatggagaagtccgaaaagatacgccgccgcaaacttagagattgcatatgccgtataggaaacgggcgtgctcagcaatctgtcatatgtatgattttcttgttcatctataaatgatcgcaggctttggactgcaacgaaccagataaacatcactaaaaatccgataagtctgtcggctgcctgtccgccttcataaacgtgatggcggtcaacattgacggcggaatgaccctgaatatccttcaagagatcagctgccgcctgcttcccgtcggtgtgcagcgtgcgggatatcacttttgcatcgcggactatttttttcagctcgcccgcctgctgcgcaatcagctgctctgtcaaaacagcatcacccttttcttcattctgaataaatgaaacgttcaattcatctccggaaaataatgtctcttcaaaatgagagccgatcagcaatccaaaggatatatcctgatgatgaacctttgtttttaatacatcctccgtgaccttcgtgacttttatatggccggctttctgaatcattttcataaattgcgctgaataggcgctctgatcctcatcagctacatatacttccttctgctgactgccatccgcagaaaaggaaaagaaatatgtgagaaggagcggggcggaaatcgtcgcaaagatggcagcccgattttgcagcatcagtttcagctgatgtctgatcatgaataacagctgcgtcatgaaacagcctccttccgtttaaacacccagatggtcaaacataaaaacacggcgccgatggcggcaagctctgccaaatccgtcgaaataccgctcagaccggcatgctgcgtgacactgacatagctgttgatcgctttgccgttcggtatcagctcctgcacgattttcaaactgtcaggcaagccgtcttttgcgataaagcttccgcctaaaaaactgaatccgtataaaatgggagccgccatgcttgagacggtctcgtggttttttgcagtaaacccccaaagaagcacgatactgccgatcgcaaatgaataaacgatcgtaaccagcaatatttcaaacaaattgccccattttacctgatacaagatgctgcttgcgatgatgacggcagccatttgcataaggatggcaagcatgattcccaaaagcttacccgccacatactggatacgtaaaacaggcattgatttgattctgaataacgtgtgctgctgtctctcttccactatcccgtgaatgagcgcaaacgcggtcataatggagaacatgacgaccattgcgattgaataatactgcatcgcatcaatcggagccgcatgattgccggccgactgtttcggaatggtgacagcctgttcacgttcacccgaaaggccgctgatgattttgctggcatctccctttgacagatgtcccgacttcttcagcaccgctttttcttcaccgatctccgcttttactctggtgacaaacgaatcagccatcatttccacaatgtctccgtttacagagccttgttggtccgagatgactttgatacttgttttttcattgtgttctgccgcttttgcaaagcctttcggcacgtatacaaaaacggagactttgccgctttcgacaagctgtttcccttcttggaaactgcctatgtcttttacacggatgagatcagtttgtttcagcacgtcattctttaatacgtcgcccaaagaactctccgcgtgatccgcattataaaacgcggtctgaaacggcttcactttcgaatcgccgtgaaaaaccgttcctaaaataaaaatcatcagtgccggaaacagaatcagttttatatagaaagactttgctccggccaataaccgaaaatctaataagatcagcctgaataatattttcatgacgccccctatgaatcccgcagcgttttgccggtgagccggaggaaaatgctttccagattggcttcctcgaaatgaatgcctttaatggtgataccagttttcctgatatcatccgcaatatcaaggatattgcgatctgccgcagagacgagcatcgtaatggtctgctggctgacagcagcctcggcaacaccgggaatgcggcggatttttttaacggcgtcatcattcagcccctctgcattcacgatcagggtatcagaggctttggctgactgcttcaattcatctttcgtcccgcaggcaatgattgagccgtgatccatgatcgccgctttttcacagaggtattcgacctcttccatgtaatgactcgtgtagatgacggtcatccctttttcttgatttaacgtcttcacggtttcaagaatgtggtgtctggattgcggatcaattccgacggtcggttcatctaaaatgaatagtttcggttcattcattagcgcggccccgatattcacccgtcttttcatgccgcctgaaaactcagatatcctttgatttcgctgttcctgtaattcgatgatgtccagcacttcatcaacccgtttacaaagttccttaccggaaagtccgtacagactcccgaaaaaagccaaattatcctttgcgcttaacgcttgatataaagcgatttcctgcgggacgactcccatcactttttttatggccgcaggctgctcctgtaatgaggttccgtcaatgcagattgttccgcccgtcggcgggagcacggtgctgatcatcgacaccgttgttgatttaccggcgccgtttggtcccaggagaccgaatatctctcctttttcgacgcgcagtgatatatgattgacagcggtaaaatcgccgtacttctttgtcaaatccgttaattcgagcattcgtgcagcactccttgtgtcatgtctgcacttattctactcttggcgatccttgttttctattcactttcgtactcgatatgggtattactttcgtcatatgtttagtgataaaaagggagagaggagggtgaagcggggttatagcaatttttgcaaatataaggtaagctcggttctgtttgacacttcaagtttatcgaggattctggatacatagtttttcacagtgccttcagtcagaaataagtctgcggcaatgcgtttattgcttttgccttccataatgtgtttcgccacatcaagctctctcggcgtgagaatctccttcagctttgaccgcggctctttctgcaccgcagggatctccatattgttcagcgcttttacgacggaaaccgtgattttgggattcagcatcatcttgccttcataaacggcttgaagggaggcggtaatttcatctgaatcagcatccttcaagagatagccgtcggctccgcttttcagcccggcaaaaatatagtgatcatcttcaaacgttgtcagaatgatgacttttacggacggatatcgcgcttttaccgcttttgtcgtttcgattccgtccataccgggcattctgatatccatcaaaatcacatcggtttcggtttgagaaagcagccggagaacctcttcgccgcaagaagcctctcccgatatttgaattccttcatgaagactcagaatcattttcagcccctctctcacaatggactggtcgtctgcaatcatgacattcacttgattattcctccttgcatggaatccttattttcacgtcaaaacccattttcttcccagacgagaaaacagcctctccgccaagtgcggctgctcttttctcaattcctttcagaccatttgattttatgatcgttccgcaggctgagccgttattatgaatatgcgccaatatcatgtttcggtttttttgaatccggacagaaacatatgaagcatgcccatgttttatcgcattcgtaatcgtttcctgaacggattgataaagacattgcttcacatccggctgttccgcttctatggccgcgtccgtctccagctcgaagcgtatgcctcccgcctcttgaaaatggctgaaaatgtcacggagctcttgctcaaatccccgccccggcaaagagccctgcagcagcataacggcctggcgaagctttaaaatggattctttcgtaagatcatgcgccttatgaatgatctgcttcactttgtccggctgatgcccggctgtcttcccggcaaattccaaattcattttcagagcagccagataatgaccgagagaatcatgcagctcctgcgcaattctagttctttctttcgtaacggccagttcctcaatccggtctgaatattccttcagtgtgtcattagcgatcttcagctctcggttcagcaattcaaccttcgacttctcctgcaggtttttccgatataaataaatcaccgcaaacatgatgaagtatggcggcacgatatcactgacacccgctccgccggcgtataaagctgcggcaaatgcggcggcattcatcgttaacaaaacagccgaaatctgcttatcagtaataagcacctccgccaataaaagcaccattacggcctgtgcccccacactatagacattgtacaaaagaactcccgcgataacgctgctcaggagaaaagagacttgatatacagccggccttctcttcatatatagcggccgcaggcagtcattagccgtcagcataatcacgagcacagacaaaaaaaccttcagctccccccggccgggaggaagctgaagaatcgcatgaaagattgatagtaatgcaaaacccctgatcagtaacttcgtatgtgcaatcttcatcgaattctccttacaaatgagcggcggctttccgctccacgttcagcacatcatacagctcatcaagcgaatgaatttcatgcgtcgggatgatctcggactcatttgctttctttccgggattaaaccagcacgtatcaattcccgccatctgaccgccttttatgtccgcgctcagtgaatcgccgataataagtccgccctcggcagaaaaaccgggaattctcgcaaacacgtaatcaaagtattccttcatcggcttttgaaaacccgtgtcctcagatacaaacacatctttaaagaacggatacagaccggagtcgcccagccgcttatattgtgatcttgagacgccgttcgtcacgatgtataaatcaaataaaggactcagccgttcaatcagctcataagctccgtctatcatctggtgcccttcttctaagtattggcggtacgcctgattcatcagcacgccgtcggcttcgaggccgtattctttaaacaaaagggcaaaccgtgtattgaccacttcatcgcgggtcatttccccctcttcaaacgccttccacagcccttgatttaacgctttataacgggcttccacctctgccgtcagctccagctttgaaccttgaaacaatttttgaagagcatcggtttctgaagcggtaaaatccagcagcgtattgtctatatcaaataataacgtacggtaatgactcatcgatgtttcccccggttctgctttttttaaccagtataccactcgcggacaagccgaaaaagacacccctgtaagagagtgtctttttgaattatacagcgtcttctattttcgatttttcaccaggcatgcgcttgccgataccgaacgcataatagctgaccgtcacaatcgccaggaaaatcaccccgacaaccaacgaaatccgcgtatctttgttaaaccacatgccgatcaataccatgagtaagaaagcgatcgtcaaatagtttgtaaacggcgcaaaaggcattttaaacggatgcttatcaagctcagcgcccttcgctcttctgaaaccgagatggctgattaaaatgacgaaccacggaatcattcccggcagcacactcgcgctgtacacatagacaaaaattttcggaggcgcgatgtagttcagcacgacaccgatcacaagtccgattaatacggcaaacgtaccgaatatcggcacaccgctcgaagaaactttcttaaagaatttcggggcctgtccgttcacgcccaatgtataaagcatgcgtcccgcactgaatatcccgctgttgcatccggacatcgcagcggtaatcacaacaaagttaatcaaaccggccgccgccgtaatcccgactttcgcaaatgtcgaaacaaacggactgccgagtgagtgaagctcattccacggatatacggtaacgattacgaaaatcgcaccgatgtagaaaattaaaatccgccaaataatactctgaatcgcgcttcgcagcgttttttgcgggtccttcgcttcccctgccgtaatcccgatcagttcgaccccttgataggccgcaacgaccaaagacaaggcaaagaaaaatcctgaaaaaccattcgtaaagaaaccgccgtgcgaccataaattagataatccgatcgcatgccctccgttaccgaaaccgaagaaaataattccgattccggccacaatcatcagaataatggtgacgattttgatcatggcaaaccaaaattcaaactcaccgaaagattttaccgaaattaaattcgccgcaccgagaatggccatggcgataatgccgggaatccatgccggcagatcaggaaaccaatatttcatatacgaaccgacggcgataatttcagacatcccgacgatcacccattgaaaccagttgctccacgccgtcatatagccggctaacggatgtatatacttatggccgaacgtcgcaaacgaccctgtactcggctctacatagagcatttcgcccatcgcacgcatgataaaaaagataaagatacccgagatcgcataagccagcaggacagacggcccggtccatccgatcgtgctggatgaccccatgaataaaccgacaccgatcgtgccgcccagcgcaatcatctgtatatgacgcgcgcctaagcctctctttaattctttgtttgccacttcgcttcctcctcttaacagctctgatatatgtgaaataatgaagcagaaggtgcacctgttgaacctaactcactcttcatttcccgcaatattagaaatattctatctttctattgttatataatctccaatttccttatttcatcataataaatttccgtggaaaatacaattgtttttttcaggtaaacaccttgcaccctaaatcaacaaactaaaaataaagcgctttcatttttgttgaattatgaatattgagataataaatgctgcagcctccgagaaacaggatgtccctggagaaacatgttccgccccctattcaatattatttttgctaagcagaatggcgtaaagccttcccctcttccattctcccttgtatacgccataatcctgcttaactcggcaaaaatcatgcattaatcgataaatgcctcattcagccgcagcaaaagccggccgaacatttctttttcatcgccggaccaatcgtcaagcatacgatgataccgctcaagacgcatctttttatcagcttttaacctctgtttgccaagcttcgtaatcgcaaacagactgacccgcccgtcagaaggatcggaaaaacgctggatcagctctttcgactccaaggccgcggcctggcgtgacaatgtggaaatatccagcttaaatgattcggccaattccttcacacgcgccggcccgaattcatccagctgccgtaataacaaatacgcagccctttccagatgtccgattttacggtcggagttatcaagataaacagctctcctgataaaagtggtgagctcatattcaattaattcaatcggatcttgttttgacaacagcctcactccttacattgacaacagcaatattagttgtataatacaaacatatgcacatttactcagaaaacatatagaaagattttgcatacatatatttgtatagtacaaatatatgcgcaaaaagtaaagaaacatatcgaagcatcaagaaagggggaagctgctcttctccaaagaacagcattgtcgtgaaagtcatacgcatcatcttgcaaatcattattttattcgcattttcctttatcgggggagccgttcagcagttctttcacctgcccattcccggaagtatcatcggtttgatcctgctgatcatatgtttatcggttaagatcattcccgccaaaatgattgaagacggagccggatttttgctgtcttttcttccgctgttattcattccggccatgacgggcgtcatcaattacccgtcactgttttccgccagcggggctgctctgtttctggtcatcgtgctgagcaccatcgtcacaatgatcgccgcagggtacgccagccagctgttagagcacaaagccaatcagagaaaggagaaaaagaagtgcagcaagcatgtatcgcaatccttataattttgttcacggctgccgcctatctggctatggtgaaattatatgtgcgctttccatatccctttctcataccggttttgacgactacgattttcattattgccgtgctgcttgtttttcatatttcgtataaagactatatgatcggcggacaatggatcaattcactgctcggacccgccgtggtggctttggcatacccgctttataagcagcgccgggtgttaatcaagtatatgtttccgatcatcggcggcgtgttggccggtttattctccggaatggtcagcggcctgctatttgcagagctgttcggcatcagccggagtttgattttgtcaattatcccaaaatcaattacgacgcctgtcgccatacagattgcgtccggtatcggcggtgtcccttccatgacagtcgtgttcgtcatgatcgcagggttttccggcgttatcttaggaccgctgcttctcaagtggatccgcatccgcagctcactcgggaaaggaattgcattcgggagcgcttcccatgcgctcggcacctcaaaagcaatggagtacggagaattaacggtctccatgagttctgtttccatgacgctctgcgccgtgttagggtcggtcttcggccccgtcgtagcatggatgtttcaaatttaaagctggcggttctccgtcagcttttttcatgtgcggatcatctcattcccttccattattatgtttcatttgtaagaataatggtaaagtagaaaacaaggagggatttaatgatgactggagcaattccgcaaaagaaactgctggatgggacaagcattcccgcgttcggcttcggtacatacgctcttaacggaaacaacggcgttcatgccattaccagcgccattgatatcggctaccgtctgattgacaccgcttataactatgaaaatgaagggacggtcggagaagccatccgcagaagctctgttccgagagaacagctatacgtgacgtccaagctgcccggacgctaccatgactatgacaaagctgtacaaaccatacaagaatctttataccgcgccggtctggactactatgacctgtatctcgtccattggccgaacccgaaacaagaccgctacacggaagcatggcaggcactgattgatgcgaaaaaatggggtctgatccgatccatcggcgtctgcaatttcctgcctgagcatatcgaacggctcgaacgtgaaaccggcgtaaagccaggcatcaaccaaatagaactgcatcccgcttttaatcagcagcagcagcgccaatggcacgaagaacagggcatcgtgacagaatcatggagtccgttatcccgcgccggcgaagtattgaacgatcaaaaactcggacggattgcggacaaatacggcaaaaccatttctcaagtcattttacgctggcatatccagctgggcgccatcccgattccaaaatcagcatcgcccgagcgccagcttgaaaacatctccgtttttgatttctcccttgatgaaaacgacatgagcattatcgactcgcttacccgccccgacggacgcataaacggccaagacccggcggagtatgaggagttttaagaaaacacataaagaaaagctgacggcatcatttgtcagcttttttctcattttatatacgcacacccagctcccgtttccattcagaaagccaatctgtatccccagatccgtattgcctgctttggccgacatcacgcagagatccgtttttatactcaatggacagcaccaaatcaggaatggcatcataccccattctcgccagcttcgtgagcgcctgtccgtaatgggcagccgcttctgccgccgtatgtttcaacaaaggatcgagctgcagcgcttccttatagacgtctaaaaggtcgcgtccgtcttctgtgacgtactttccgtccacgatctgcaagtctttcagatgatagccggtcacctcatacatttcccgaacgacttgatatttctcatatgtttccggcgtaaactgcgaggagtcatcactccggctgcgaatgatgtgcgcaaacagctctttgctgttttccccggagtttaagacagcttcaatctgctgagtgagctctttatcgtcagtcccgctcacttttaacagataatcaatcggtgatatcgtaaatgtaagattcgcaccctccggaatctgaatatgattccgatggaaaagcatctcaatctgctgattcacctgcccgcgctgaaacaccttttcattttcgacttgaatctctccgttgagcgtttcaccccgaaacgccgcatcacggaaatcatagctctgggccttccccttaaacagccattccgtttcattatgataagcggcctgacgctccgattctgataaatcacttctgaaataaggtgaatcggcaagctggtatttatccttaatataatgcaaaggatctggttttcgtttattgatttcattgatacggctgtatttctcatcaagaatcttgctcgcaatatcactctcagactcatacggattattagcgtctattaccgtctcattcccattatccgtaatcgttttctgatttgcagattgatataaacgggacaggctgctccctttctcagtgacaccgctccttgaataattcacctggctcagatcgcggctcccgcctgtctgaatcaataagctgtccgatccttttgccgcatctttcacatttgttttggaagaataccgctgaagcacttgctgagccattacttgattttttatatatcgagcgtttaggcgcatgtttttaacctccgcttgagatgatgttctagtgtttttatcggctgtcttcaagtagattttaaccttaaataacaaatgtttacatagctaatttttctatgtatgatgtagtcaaaaagggggaattttccatgaagaagtatatatctatactatttgtcagtgcattcgtattatcaggcgcattgtttgcatcttcaccttcagcctctgcgtctcaaaagaactcgttacaaataagcgccattacaggaaatcattcatttgaaactgccaatccggtaggctactggaaatataaaaatattgatactgccatattgccaaaaggggaaaaagattcgtatttcactttcacggcaaataagggagaaagactttatgtcaggagttcaacaagaagtgaatacaagggaatggacattgaaatttataataaaaataaagtactgatcagtaaaagcacagaagtgataaatcctgatacggcgctaccttttatctatgcgaatacagatgcgaaagaaaataacgagacgttctacgtgaaagtgtcccgcggctcctacactgacgatatgtactttacactctctatttacgaccgaatcaaatccggcagtgagaccttctcattcagcggtacagctgaaaataaagggaacacaagcctcagtccgaatggatcagattcaactgttcttagactcgacttaaccaaacagacaagcattccaagagacgccacagtgaaaagaatcaacaccaccgcaacccaaacaccaagccaaggaaatacaagccactacataatgtcggaagaaaataaagtgtggcaccgtgcacttgcaaacagctccactcaaggaaattacggtatcacactggatgataacctctcagtctcaagcatctggaattttaaatacaacacactcgcaacagcaaaatcgactatgaaaaatgtgaaattgaagattgattatgagtacgatgtgacaacgcagttttaattagaagaacagccgcccattgtgcgggcggctgtctgcttggagttaaagtaaatttatgaacccgtgccatgccgtatcctgttataacttgatcagttgctaaaattcttttttatgatatatagctgcggcaatgaaaaatgaaatgatatataagataacgccgatcatgagatatataatcgggacatataaagaaggatttatgtgcaaaaatgacagcggtacttgttctgctgcatacccaacgacactttgcaatccaaacgtagcaaaaagtccccccattgctcctccaatcacgatagcatcggatttttccgggcctatcatgtagagaagaggataaacgattgcaccggcaaagagaacgatgaacgttccaaaagagacaatattaaatatgccgtcaatcggttcatcagaacccaggctgtatacaaggaaaataccataagatattacagctccgatcacaacaatcaaaagatagaagacatagtggctttgaacaatatttgttctgctgaccggtaaagtcaggacatacctgtcatagccagacttgctctcatactttataacctcaagtgcgggcatgacgacaaacaaaataatcagcatagcaacaaaacgatgcattgaagcatccccaaaataaaaaatgactgctgataccaatatggccaaccccgtgtatgcaaagaaactccgataaaccaagtaatagttagtcagtaacagacctctcaatgttttcactcctcgttaaaaagacgctgatttcttctatggaaatggtgttggccgttacgccattcggcaatttctgttgatccgatacaagcacactccaataagatccacgatccctttttgctagaacgatatcttcgtcaagctcagccaatcggccttcatcaacgtctataacggtatagctttcaagaaccttatctttctcttcatttaataaaatttcgccatctttcataataacgatatggctggctatcttctcgacatcagtcataatgtgcgatgaaagtaaaataccgccgttgcttttgctcacaaagctttttaattcatttaacagatcatctcttgaagagggatcaagccctcccgttgcttcatccaggagtaataattttgcattatgcgacaaagcaacagctacggataacttcattgacatgccgcgcgagaatgtattcacttttttgtccataggtaaagagaaagaatgaaccaaccggtaaaaatgatcttggtcccaagcaccgaatagtttcttaaatacatgattcagctgctttatcgtaaggtgcgcaggaagattcatcgcatcaaatacgaccccaatatcttctttgaactttatatgtttatccagattctctttaccaaagattttcactttacctctatcctgagaaattaatcctaatatcgttttaaatgttgttgacttgcctgcgccgttatcaccgataaaaccgacaattgatccggcaggcacattgaatgtaacatcctttaaaacagctttatgaccaaaagatttgctgatgtttctgatttctaaaaggtttgacatcattccactcctatcattgtcgtcaggacttttttaagaattgaaccggattattgcaaaaatgttgtgattttcatatctggtctaggtattcataatggatcaggagtcgggaaatacaaaagggattttaaagtcttaagcataatatggaagtgtaatcgattgattacgtttatataatgggatattcatgatgaaaactgctgaggtgtttactttccgatgaggtatacacaaaatgatttactaatgattacatttatggattttaaccggaatgcatctcgtattataaagcaggtgttactccttttcaatatataaaaggggatttctttacaatcgcaaagagtatgcatttctcatttccgcattaaaaaacccctctggctaataatgtagctttcgaataaagttcaattaaaagcattttgcaaacgttgattttataatagaagaaacccacacattttgaacaaagtttgatcaaaatgcgtgggtttgatttttgtgtggagtttggttttataaaaaagattgatataaaatatcaatttcccactatgtatatggcattaactaaattcaaagcaatcatttagttaacactttggttaatttcttttataaaagctgtatagtcagatgcttttaggtcacttaaattagtattgttccaatcacttatatcagataaaaattcactgacgttatttgtgatactctttattctttttaactcctgtaaaggttcaatcttatttgtatcttgagttattttctgaatcatttccgagtatgccttctctttctcttcccaatatgatatatatcctatcctttgctcaaaagaatatatattagctgcaattgtagtcggtatctctgaaagtgaaggtacaaattctttatcagaatcttttagtataactaataacattttctctttatattcacgcgaacgcataacttcagatatctcatacatacaatttactgattttaaatattggtcactaataatactaataacaaaatcgtgtttcccaatagttttcatgaaatctttaatactatctttaaactcaatgtttcgaacatctctagtcaaagtataccccatatttttgaaatcattatcaattaaatcagcaaacgctacatcattccaacaatatgaaataaatatcttctggttcttcatctgttcagccactccactatcaccaattttataaatcgttttatttactgttactaattcctctgctttattaatagagatataatatagcctaatgtcttttaaagtaaagtactcacttttaatatttataataccctctatcaaattttgaactctctccaaaccaaatctaaagggaaaattctttatttctaatctttttccatcatctcgtattccaaagactatatctccaccgttactgttcgagtatgcaacaattaattttgctatttcttcatgactcgcaattgggtgtatatatgttgtattctgtctattatttgtacttattttgttttcaatatctttaattgttctaaacactaaaaagtacctctcttataacttagtcaatggaattttagatatacctgttgttttaagcaaatcacctaaagtaaccattcgttgtacttctccatcatccgtccataattgatagttgacatcatctaaagcctctaattcttcatcataataaaatattattttttgataatcacttggacgaataatgattctaaaatcatttccgttatacttagccggaaataccgtatcagaatacttttcattcatccattcttctaaagttgccggaagtgtataatctttaagtctgcttaaatacttaaaaatattttctgtacttctatgtagtaatttctcaacatagcgtttcatttcttcggatgaggtaataacatgttttaattgattgataatatcttctttactcagttcagagttagttacaatctccattattttatctcgattattaataatttcatctaattcttcaaacttaatgttattttcctctattttttccgctattctatatcttctcagattttcttctggagaagataacatcattctctttgaatataaattcccaaaccatttttttgatttttcaggatttgataggaaccaattagttaatctattaaatattttttgggtagattcatttctttctatcctgtcaatagtttcctcactgagaagttttgatactttgagctcaatttgatcagagcatatttcattagtcttaatttttttggggtgttcttcgaaatagtgttcaaatgaaataatatctactttcaataactgtccttcaattttctcacccaataatgttaagatctgttttaattcttgatctatatttttatcaagataaatacaggcgaactgtacaaattcattaatttgattcggtacaaatgccgattttacaacttcatcaatacctgcatccttaatccaaagagaaaaaaatgcatttaaccactctgcatatagagtcttatcattcaaacaagcaactaatttatcaatatttgaatcttcaaaaatatcgtttatccaagagaatccagcattctctccaaaaacctccgcccagcctaagtaagtatctttagttggtatcgatactccgttataattagataaaacatcccaaagtaagtccttatgtgtgcttttttttgtttttggtatgcctattgctacgttaccattattatctttaaatgctaatcgtttcaaatcttccaaatgattatgaataggaacaattggactcttctcaatatgctctttaatttctttatagctataagcctgaatatttgatgaagtagagggttttaaaatgcaaatattaaattcatttcttgtccttttactttctgaacaataatctattaattccttgtataaagagacagctacctttattaattcattatttactggattgctatctctaatagcatttctgtccctttctacttcaaataatcctgaattaactactataggaaaactaaatttttcagttcctaatagaggaaattcacaaaagacccttggcatggcatcaggaattggtaagaaatataatttcttgtctttacgttcgatagcacaaccaatagttacattattttcatttaatattagcaactctttaatactatcagaaacgttaatttgaacagcttttagcttgttatttgaacgtgaagtttctactttctcctttttgtaacaatcaccattgtatgtaatagagttgatattcttattaaaagttaatacataaggaatagtctcttttaaatcttctatcccttcctctactgcttcttttatgtcatcatcctgtattaaataaacgaattttgtatcctcatactcttcttgtaattcctcttgatttctgcttacaagatctaattgttctagcataatttttgttttattcttaatatcgctataatcatctcctgacctatcaacaatgaactcaaattttgtatacctactatcttcttggctaaacgacccttcaattcgtacaacctctgataataaatgagtcgacataaaacctgttccaaattttcctgttttcttttcttctgaactttgcttagatgagatttgtgtgattaaatctaataaattttcatacgaaaatggcagtccattatgactaaatatgatttgattattagagtaatcaatttttatatctattttcttacctttaggtgtacagtctgatgcattttgaattagttcccatatccatctacgcctaatagtctttttttctatttctgaagactctcttatctttttcaattcatcccaaattgtattagaactcgcatctaaaactttatttaataaaacctcttcattagacatagtaataatcaaacctctttttccctgtatttttctgaattcccgggtattaatttctttttattttcggcattataagatttgaggagccttctatattattcatttaaatatcctttacgaattctccaactctcttgatttaagtaaagatgataatattacctagatctcgaatgggtttaaaactacttcaaaaacattaactgatatttctcagtatattgattttgtacaaccttctaaccaatatttattcgtctccctaagcctttatcataacaatgtgttcttttgttttaagaactgtatgatggtttatttctaactcatctgcaacctttcattgataatataatctaatgattatcttgtatgctaattttattttctaaatattcagttaaatgttataattattgttttatatcagatagaaggctcctactatcttccttattcaatttattataaacgatgagcatcctttttgaagttaatacttgaatgtttagctccagtttatgtattttttagctcctatacctttttcaatcaatttttctacttagttttctgtttagacatgaaaatacccctttagatgagtatatctaaaggggtagaacggtgcaactttttccaggaacaatacaaactttgaatttaaaacaacatactgttttctttccttgtcaaatccttattccacagtcacactcttcgcaaggttgcgcggtttatcaacgtcacagccgcggtgcagtgcagcgtagtaagcgatcagctgcaatggcacaacagataccagcggagcaagcgcagggttgacttccggcaggatgaatctgtcgtctgcgtcttctaagcctttcagcgagatgatgcaagtgttggcgccgcgggctgcgacttccttcacgtttccgcggatgctcaggttgacgtgttcttgtgtcgccagtgcaaagaccggtgttccttcttcaatcagagcgattgttccgtgcttcagctcgccgccggcgaagccttccgcctggatgtaagaaatctctttcagcttcagggcgccttcgacacatacgaagtagtcaaggccgcggccgatgaagaaagcatttcttgaaacagtcaggtactcacgcgcgatcatttccatttcgtccttctggtcgcagagggcttccatggcgtttgccgcaatacctaattctttgactaaatcaaaaccgatatcaacaccgttgcgttctgctgcaacggacgcaaggatcgcaagcacggcaatctgagccgtatacgcttttgttgatgcaaccgcgatctcagggcctgcgtgcagaagcaatgtgtaatccgcttcacgggaaagcgttgatcccggaacgtttgtgatcgtcagcgctttgtgacccagcgctttgacttgaacaagcacggcgcggctgtccgctgtttctccgctttgagaaaggaagataaagagcggcttcttagacagaagcggcatgttgtaggagaattcactcgctacatgcacttcaaccgggacgtttgcccacatttcaatatattgtttcccgacaagaccggcatggtagctcgttccgcaagccacgatataaatacggtccgcttccgccacggcgtcagcgacatcgccggccacggccagtctgccattttcgtcttgatacgtttggatgattttgcgcataacaagcggctgctcatccgtttcttttaacatgtagtgagggtatgtgcctttttcgatatcactggcgtcaagctcagcgatataagacgcacgtgtcatgacttcaccgtcaaggtttttaatcacggcttcgtcttttgtcacgatcaccatttctttgtccaaaagctcaacgtattcattcgttacttgaagcatagccatcgcgtcagatgccacgacgttaaacgtatctccaaggccgattaacagagggcttttgttttttgcaacgtaaatggtgtctgtgttttcaccgtcaaataatgcaattgcgtaagagccttttaacagagtcagtgttttgcggaacgcttcttctgtgctaagtcctcccgccacaaattgctcgatcatttgaacgactacttcagtgtccgtgtcgcttttcagttcaacgttttcaagatattcgcgcttcagctgaacatagttctcgatcacaccgttgtgaacaagtgtaaagcggccgagtgcgctttgatgcgggtgagcgttcaggaagcttggttcgccgtgagtcgcccagcgtgtatggccgattcccgcttgagattcaaccgtgtgatccaccacttcacgaaggtcggcgatgcggcctttttctttgtacacatgcacgccctgctcattcgccacagcgataccggcagagtcataaccgcggtactcaagcttctctaatccttttaacaaaatctctttcgcatcaagctgaccgatataacctacaattccacacattttttcttcctcctaaaggtgcaaaaggagacgaagaaagtcaaattacaaggggactttcaatcgtcccctcccacatgtttttttggaagatcatgtgatttctctttgttcggagagtcgcccctccggtttgaagaaatccttacggctgtgatctaaatgaatcagccgggaggcatccgccgaaaattcgataacctccatcctcgtcaactaagccgtttttcgggcgcttagttcgggcgctgtaattataaaagatgcaaacaatcccgcctttcctgcaagtgaaaaacaaaggctgaacaagcttgattttacagcatgtgccaaggacggtcaattattttttgccgccccggcatcatgtttactatcatattatgctgatcgcacttgtcttgttcgctctctgcttataaacttcgctactccgctcccatttctgtccgcacgacatccacgatttttgtgacatattcgtcacaaagctcttttgttctcgcttcggccatcacgcggacgagcggttcggtgcctgacgggcgcactaaaatccggccgtctccgttcatttctttttccacttcagaaataacggccttcaccttagcgttttcttctaccttatatttatccgtcactttcacgttcactaagagctgcgggaattttttcatttcatccgcaagttctgaaagggttttgccggacgccttcagcgtattcacaagcatgatcgcggacaaaagaccgtcgccggtagtgttgtaatcaaggaaaataaggtgccctgactgctcgccgccgacattatagccgtcttttttcatcgcttctacgacatagcggtcgccgactgccgtttgaacgcttttgatttcttctttttcaagcgctttgtagaaaccgaggttgctcatcacagtcgatacgacggtatcatccttcagacggccctctgatttcaaatacttcgcgcatatgtacataatctgatcaccgtcgacgatgtttcctttttcatcaacagcaatgaggcggtcgccgtctccgtcaaacgcaaggccgatatcggcgtttttttctttgacgaaagcactcagcgcttccgggtgtgtagaaccgacgccatcattaatgtttaatccgttcggagacgtccccattgtagatacgtcagcatcgagatcggcaaaaaggtgcgtcgcaatggatgatgtcgcaccatgggcgcagtcaagcgctacatgaatgcctgtgaaatcttcgtccgccgtctgctttaaaaattgcagatacttttgaacgccttcaaaataatcgtttacaagcccgaggtccgcgcctgtcggtctcggcagcttatcttccggttcatccatgagacgttcaatctcggcctcctgctcatcagaaagcttaaagccgtcccctccgaaaaatttaattccgttatcctgtacggggttgtgagaagcggagatcatgacgcccgcctcagcatccatggctttcgttaaataggatacccccggcgtagaaataacgccgaggcgcatcacttcagctccgatcgataaaagtccggcgacaagggctccctccagcatatgtccggagatacgtgtatcacggccgatcagcactttcgggcgctgcttatctttggtcaggacataaccgccaaaacgcccaactttaaaggccagctctggcgtaagctcgctgttggcaacacctcttacaccatctgttccaaaatacttgcccattttgtatcgctcctttttcattctgttgaagaagaatcagcgcttgatccgtcttcatcctggtcttgattttgatcctggttttgacttttattctgatcgctgtcagtgtcgtcttcccggttcttgttcttgtctttgtctgcgtctccgcttgtgccgttcttattgccggaatcagcggagccgccgtcatttttatttgaacttgtgtttttcttagaagtcagcttgatcttaaccgtgtcttttgacagggaccatgtgacgttttgcgggccgtttacttcaagctttacagagtgctctccgtcatccaagtccgagacattggcatacagttcaatgtccgactttttcagcgccttaatgttggcgggagagcctttggccgtaatatttatcgcctgcgattcaggatcgagaaactcaatctgctgtgagcctcccagtccgaccgtcttgattccgacattgtcaaaatcctttttgtcttcactgtccactttaacatgaagcgtgattttttccggtgataccttagtgacacccttaggaagcgggatatcggcattgatatcggtatctttatcaattttgcctaaatcaagagatacgccgtcaataaattcaagtgaatccagcacatcctgcgggccgtaaaccgtcacctcactcggattcgagtcaatgctcgcaacgctcaccccgtccggaagacttcccttcctttcgattttgaaaggaagctttttgctcggactggctacgggaaccgtcactttaatgactgacggttcaacatcaacaggaagtgcgttgccgtctttgtcatagacggtcaccttcacttccttttcaatggtctcatttgcattttctaggttcacggatgctttgacaagtgaaatgttatcaatcacatttttcgaacctgtaatctgcacgtttttcgggctgataatcggctgctgaggggtgtatccctttttcattttgcttttattgtagtattcaacttccacgggaaaactctcagccgttttttcctgaatcgtaaccgtcgtgactgacgggttaatggagatcgtcagtccgtccgatacgtttttcgccttcaattcgaccttatgagtcccggtcttcagcttattcatatcggcgtatatctcaaaattctttgtctgtctcgcctttttcaccgcgcttgtcgagcctttaatcgtgacatttacggtctggggcacgccggtgacgacatagttcgcttcatcatagtatgcttttacaggaatatcagtaagcgtagcctcgtcagtcgttgatgtcggaaaaaaggattcccccggctttttcggagtcggcgcctggttgttgttaaccgcaacgtaaagcagcagcgcaaagagcaatgcaatgatctttacagcccagcggttgtttaagaatttatccatttttcttgcccctccagtaccagcggttagaagaagtatctctggcgtttttcttaaactcggcttcaagcatttctttcagtgcttcttccgtcaattctctgtgaaggtctccgtttttggccacactgatggcgcccgtctcttcagatacaataatggttaagctgtccgtcacttcactgatgccgacagccgctctgtgacgcgtccccagctcctttgaaataaacgggctttcagaaagcggcagataacaggcagccgccgcaatctcgttatttttcataatgaccgctccatcatgcagcggtgtattcgggatgaagatattaatcaaaagctccgagctgacctgtgcattaagcgggatgcccgtctcaatataatcgcccattcccgtatcgcgctcaatcgcgatgagtgcgccgatgcggcgtttcgccatgtagctgatcgattttgtaatcgcttcaattgtcttatgctgcgcttcctccacgggggttccgctcctggaaaagaaccggccccgtccgagctgttcaagcgcccgtctcagctcaggctggaatataatgatgatcgctaaaaatccccatgttatcgcttggtccatcagccactgaagcgtgctgagtcccaaatatgaactggccatccggaccaatacgatgacgacgattccttttaaaagctgaaccgccttcgtcccgcgtatgaccatgattaatttatatatcacataccaaacaaggagaatatcaacggcattgccgaggtattgcaaaaatgggatgtcctcaaaagccatttcctcgtcctccaagaattcagtcatttcgtttttctgttatgaattgtgctgcatgagcaatatgtacatcatatagcgtgctcattataccacattttgatttctcaagtgaaatgagccagagcggcgatgcacaaaaaaagagtaaagcgattatacgctttactcatcttcactcgggtccaaagcgctcacgacgccctggcccgccgatttcagttcgtaccagacccagtcaaacaattggttaatctcttcaatctgcccggtgacttgtccggctgaggccatgtatttttctccgttgacgacggtcacattgccgtcgacttttccttcaatgaacagcttgccgttttttactgtgacatcgccctttacggtctcgccttcagggacggtgaccgtgtgattctgcacgacaaggttcggctgtttggacacactgaaattgtggtcattatgccagctgttgaaaaaaccgccgcccattaaaatcacaaaaaccgctgcggctgcaatcatcggatgagttttgatccatcgttttacagaagcgcgttttttctcttttggaagattcgccataactttggcagtaaaatcagcaggggccgtgacatgcgatgtgcttcggacgagtgctacggatttctccatttcatgaaaatgccgtttgcaattcccgcatgactgcaaatgttgttttaatacgttttcatcttcaggaaggatatctccatcaagatgcttatgcataagctgcacaatctgttcaggacagctcatttcatcaccccacttaaagatccctcaattgttttctaagagcctctctgcctctgtgtatccttgtcttgacggtgccgacagggatattcagaatctccccgatttcaattaaagagagttcgtcaatatactttaatacaataaccgttctgtacttgtcaggcagctttaaaatctttttctgaattgtgtccgacagctccaatgacaatacggcgtcttcagggagaaccccgtccgcggcgatctgcgaatacatcgtcagcccttctgctcccgctacttctgcgtccagatagtaatcaggctttttcttgcggatgcggtcaatggtcaggttggtcgcaattctgtaaagccacgttgaaaactttctgttgatatcgaaactgtcgatattgacatacgctctgataaaagcttcctgcgcaatatcttccgcttcgtgaacattgccgagcatgcggtagcaaagctggtaaatcttatctttataaaggtcaacgatttctgcaaacgcattttgatcgccttttttgacttgcttgattctttttttaatcaggttttccatgttttatcttacctctgcccttcaccggtctgtatctatacgttgattgttttaaaaggtttcattttttttattacatttattttaccaaatttcaggcagggtgtagatggaaaatacagaatatactgccttaacagcagcttaaaaatagtatatctgatgaacaatcagaaatcgaaacaaaatgctgataaaaaaagacacctttatgcaaaaggtgtctgagactgggctagctggattcgaaccaacgcatgacggagtcaaagtccgttgccttaccgcttggctatagcccaaaaatggtggaggggggcagattcgaactgccgaaccctgagggagcggatttacagtccgccgcgtttagccacttcgctacccctccgtatatttttgaaaaacagtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatgacccgtacgggattcgaacccgtgttaccgccgtgaaagggcggtgtcttaaccgcttgaccaacgggccgttgtgtccgcgtcgagctgacaaaagttattatatacaggttgtaccccatttgtaaagaggaaaattattttttttattttcaaacttttttacccgttttttaactgaaaaactcatccctcctctcttatttcatttatgatgaaagtatcaaaatattgaagggaatggacacagatgatcttagtcagctcttgtctcggcggtatcgaatgcaggtataacggctctcacgccgcttcggaaaaaatccgcagactcgtagaagaaaagaaagctgttatggtctgccccgaacttttgggcggcttcaccactccccgcgaaccggcggaaatcatcggcggcacgggcgaagacgtgctgaacggaacagcaagaatcgtaacggcatcaggcgaagacgttacggctttatatatggacggcgcggaaaaaacattagcatacgcaaaagaaataggcgccgccacggtcatccttaaagaaaacagtccgtcctgcggcagcagctttatctatgacggcactttctcagggaaaaaaataatcggagacggcatcacttccgctcttttaaaacgggcaggctgccgtgttctatcagaagatgaattggatcaattataaaaaaggagagtagatatcatggatgtagccctgtccttttataaaccggagcatgcagacggactgaacgggtttgtgctgagtgaagaagataaaaagttcacagctctcccgaaggatgtcctgccgcaggctcttgtcatccgggatcgctacccgacagtcattttaaaagaagaccgccccgtcggtttttttattttacatacctcaaaagaaaccattgccccgtattcgaataatgtgtctgccattttgctgagtgcgctgtccttacatgcgccgcatcagggaaaaggttatgccaaacaagcgatgctgcagctccccgcttttgtcgcaaattactttccttggtgtgatgaaatcgtgcttgctgtaaaccatcgcaatcatcgtgcaaagaacctgtaccggtcttccggttttattgataaaggtcgtcgcaggatcggcccgatcggtgaacagcacattctgcatcattttttgtgaaagcgcttgattattcatctcatccctgccgatttttcttgaaacatctattcagaagcccatatacttcaagtattaacgacttgggagggtacaatcatgacagaccggcttaacattcacagattgaccacagaaaccagaaatccgcagaccgcttcaatccatcaagcagacacgatggaaattctccgcatcattaacgaagaggatttcaaagtggctgaagccgttcagcaggtgctgcccgatattcagattgccgttcaattcgcccatcaatcattacggcgaaacggcaggctgatttatgcgggagcgggcacaagcggcagactcggtgtactggatgcggttgaatgcccgcctacatacagcgtaagtcccgacactgtcatcggtctgatggccggaggagcagacgcctttttgcaagcggctgaaggtatagaagacagcgaggaaaccggcgctctcgatctcaaaacgatcgggcttaccgcagaagacaccgtgatcgccatcgcggcaagcgggcgcacgccgtatgcggccggtgcgctgaaatacgcaaaaacaatcggcgccaaaaccgtcgcgctcacatgcaataaggactcattgatcagcacctttgccgatcacagcattgaagtcgtcgtcggccccgaagtgattacagggtcaacacgaatgaaagcggcgacggcacataaaatgattctgaacatgatttccacggccgtgatgatcaaaagcggcaaagtgtacgaaaatttaatggtggacgttcatgtcagcaacgaaaaattgaaagaacgcgcaatcggcattatccaaagcatcacgggcgttccgtacgacaaggcaaaagaaacgcttgaggccgcaggcagccatgtcaaaacggcaatcgtcatgctgaagacgaattcagacgaaacacacgcgaaggcactgctcaaagaagcagaaggcttcattgacaaagccatagaacagcacgtttcaaaagaaaaagaacgctgatcgttctttggtgaaaaataatgtgcttttacgagcccgcgccgttttcatgatcggcgcaggcgcttttaggacgcgtttcaggcacagctccccgggaaaaatcgcacggaaaaaaggaggatctccatgagcaaagaggcattttatcagtcactggccaaagatatcctggacaattgcggcggttcatcgaatatttcaggctttacccactgtatgacacgcctgaggattacacctttagatcgggacaaaacggatattgaggcgctgaaacggcttgacggggtaataggcgtcgtcgaagccgaaacactgcagatcattctcggcacgggtgtcgtcaatcatgtcgccgacgctttcgcaaaacttatgtcatccggaaaaaacattgatttaaaagaagccgcctcacggaaaaaagccgatctcaacagaaaaaacaccacacccatcagactgtttctgagaaaaatatcaagcatcttcatcccccttattcccgcactcattgcatcaggtttaatcaccggtattacgaaagccgtcattcaggccggctggcttccgaaagaatcccaaatcgcacttattttaacggttatcggttcaggcttattcgcatacctcggcgtccttgtcggcatcaatgcggcgaaggaattcggcggtacacccgcgatgggcggccttgcgggcatattgatccttaaccctgagatcgccaatatcagtttgttcggagagaatctgctccctggcaggggaggattaatcggcgttcttttcgctgcggtttttatcgcttataccgaacggtttatcagaaagtacgtccatcaatccatcgacattatcgtcacgcctacattgtctttacttatcaccgggctggtgacatatgtcgtttttatccctgcaggcggttttatttctgatctcattacatcaggtttattgtcgctgctgaatgtcgggggagtgctctcagggtttgtactgggagccgccttcctgccgcttgtcgtcaccggcctgcatcagggcttgactcccgtacatttggaattaatccgatcaatcggagatgacccgcttcttccgattctcgcgatgggaggcgcgggtcaagtaggggcggccttcgccatctttatgaaaacaaaaaaagcctcattgaaaagagcgatcggcggcggacttccatccggtctgctcggaatcggagagccgctcatcttcggcgtcacgctcccgctcggccggccgtttttgacggcgtgtttaggggcgggaatcggcggcgcctttcaagcccattttcaggtggctactttttcaatcggtgtctccggccttccgctctcgtttctcgtacagccggctcaaatcgttttgtatatcatcggtctcttcatctcttacgcggcgggctttgtcttcacttatgcgttcggatttaaggatgacatggctgctgaatttgaataaaccgggagggatcagaatatgaaaacactgacagccgccatactcacaatggtcatcagcctctcttttctgccgcagcacaaagccgaagcccaatccaaattatacgacgtagcaaagcttagaaaggttgatcaaatgattgaaaaagacatcgcagcaggattccccggagccgtcctcgtcgtcgtaaaggacggacgggtgatcaaaaagaaagcatacggctacagcaaaaaatatgacgggaacgtccttttatcgcgtccgaaaaaaatgaaaacatcaaccatgtttgatctagcttccaatacaaaaatgtacgcggcgaattttgcattacagcgactcgtcagccagggaaagcttgatgtgtatcaaaaagtctcggcttaccttcctgatttcaaagacagaaaaagcgatccgattcaagaaaaagaccgcattcgcgtcatcgatgtgctccagcatcaatccggtctgccggcaagcttttatttctatcagccggacaccgcaggccctttgtattcacaagaacgggataaaacgatccgttttctcactcaaatcccgcttgcatacaaaccgggaacaaaacacgtatacagcgatatcggttacatgcttctcggctgcatcattgaaaacataaccggaaaaacccttgatgcctatgcggaacaagaactgtacaaaccgctgaaactgacgcacacactgttcaatccgctgcaaaaaggctttaaagaaaaatcattcgcagctactgaacgtttaggcaacacacgtgacggagtcatccgtttccctcacatcaggacgtatacgctgcagggggaagttcacgatgaaaaagcattttactcaatgggaggggtgtccggtcacgccgggctgttttccagagctgatgacatggccgtccttcttcaagtcatgctgaacggaggcagttataaacacgtttctctcttcaataaaagaacggccgatttgttcaccacggcggcatcctctgatccgactttcgctctcggctggcggaaaaacggcagcccggatatggagtggatgttcggcccttatgcaagcaggcaggcatatggccatacgggatggaccggcaccgtcacgattattgatcccgcttataagctggggatcgcacttttgaccaataaaaagcattcccccgtcgtcagtcccggtgaaaacccgaatgtttttgaaggggatctttttccgactggaagctacggcagcatcataaaaacgatttatgaagccattgaatgacaacccatgtcttttgtccaaactatgacggcaggagggcaccatcatgaaacttgttatctcagctgtattactgttgttcattgttttcggcacgcatcatgtatcgacaaaaccggacattccgtcacaggcggaacaagcggtatcccgtatgacattagatgaaaaattagggcagatgctcatgcctgattttcgcaattggcaaaaaaaggggcagtcatcacctgaggctcttacccaaatgaataaagaagtcgcagggcttattcaaaagtaccggttcggcggcgttattttattttcagaaaatgtaaaaaacactgaacaaacggtacgcctgacagatgcctttcaaaaggcgagccctgacattccgctattattaagcattgatcaggagggcggcatcgtaactagacttggtgagggcactcatttcccaggcaatatggcgctcggagccgctagaaaaacagcctacgcgtcccagaccggcgccattatcgggaaagaactgaaagcactgggcattaatacgaacttcgctcccgttctcgatatcaataataatcccggaaatcctgtcatcggcgtcaggtccttcagttcagaccgagatctgacagcttcactcggtcttgcctcaatgaaggctcagcaaaagcaggatgtcgctgccgccgtcaaacatttcccgggacacggcgacacggatgtcgacagccactacggccttccgcttgtcacccacaatcaagaaaggctgcgtcagattgaactttatccgttccggaaggccattcaggccggagctgatatgatcatgacagcccatgtgcaatttcccgcgtttgacgatacaacctataaaagcaagctggacggttcagacatcctcgtacccgccacgctctcgaaaaaagtgatgactcatcttctccgtgaggaaatgggctttaacggcgtcatcgtcacggatgcattaaatatgaaagccattgccgatcatttcggccaggaagaggcggtcgtcatggccgtaaaagcaggagtcgatattgccctgatgccggcccaagtgacatcgctgcaaacagaaaaccgctttgcccgggttcattccgcattaaaaaaggcggtacaaaaaggggatattccgctgcagcaaattaacaaatcggcggaacgcatcatttccctgaaaataaaacgagggatatatcccgcaccgaaagagacaaatctgaaaaagaagattgcaaaagcaaagaaaaccgtcggcagcaaaaatcacctgaaagctgaaaaacaaatcgcggaaaggtccgtcaccgtcttacaaaacaaaaaccgcacgctcccattcaaaccgaaaaagaacagccgcgttctcattgccgctccatatgaagatcaaacagcgtcaatggaacaaaccattcggcagctcatcaagaagaaaaaaatccggccggtaaccatcagtaaaatgaacttcgccgagcgcacatttcatgatgaacacaaaaagcagataactgacgctgattacgtgattacaggctcatatgttgtgaaaaatgatcctgtcgtaaacgacggcgtgattgacgattccgtcacagatcccggcaagtggacgactgcatttccgcgggcagtcatgaaagccgcacaatcgaaccaaaaaccctttgtgctgatgagcctgcgtaatccatatgacgccgcgaactttgaagaagctgaagcccttatcgcagtctacggctttaaaggatatacagacggacaatttctccagccaaacattccggcaggcgttgaagcgatattcggacagacaacaccgcaaggcaggctgcccgctgacattccttccgtcacgcatccgggaacgacactgtatccttatggtttcggtatcaatctgaagaccggaaaaccgctttaaacaggaggactgatcatgaaaacacaaacggctgcgcttcttgccggattagtcgtcatcagtgctatgacggcagtctcggcggcttctgacagaaaccttcataccgccaagaaaccaagcatccaaacaggcatcgaccgcctgctgaaagattataaacaggaactgaagggaaaaagggtcgggctgatcaccaacccgaccggtgtgaacaattcattgaaaagcagcgttgacgtgctgtatgaggcaccagacatccacttgacggcattattcggaccggagcacggtgtccgcggcgatgctcaggccggagacaaagtcacatcgtatatagacgaaaaaacagggcttcccgtctacagcctgtacggggaaacgaggaaaccgacgcctgacatgctgaaagatacagatgtgctgattttcgatattcaggatgtcggaacgcgatactacacctacatttatacaatggcctatgccatggaagcggcaaaagaaaaaggcattcctttttatgtattggaccggccgaatccgcaaggcggacgaaatccggacggcccggttcttgaaccggattacgcttcatttgtcggactgtatccgatcccgctgaagcacggcatgacgatcggtgagcttgctcttttattcaataaagagtttcatattggcgccgacctaaccgtcgtaaaaatgaagcgctggaagcggacgatgacgattgaagataccggtctgccgttcgtcctcccttcgcccaatatcccgaccccggacagcatattcgcatattcggcgacaggactaatcgaaggcacaaacgtatccgaaggaaggggcacgacaaagccgtttgaactgatcggcgcgccttatatgaaaagcaccgagctcgaagaacgcctgaacagtctcaagcttccgggcgtcaccttcagagccgcatcatttatccccagcttctccaagcaccagggcaaactgtgccacggcgtacaagtctacgtaacaaacagaaatacatttgaagcggcaaaaacagggctttccattctgaaaaccatgcatgacttatatccgaatgacttttcattcttgccgacaggctcttttgacaagctgatcggtaacggctgggtacgcaaaaaaatagaaaaaggcacttccattgaagacatcaccggcacatatcaacgccggctggaccaattcaaaactctaagaaaacaatacctcatatactgacaacattcgtgttacacgtgtaacattttgacgcatttcacatttccgctttttataggaaaacattcatttatttggtacaatttaaatgataacagttatcatttaaatgaatgtttcctaaaaggtggtttctcatgaaaaacacattattctttcagcccattgatatcatctccgtaaaaaaaacagccgaccttctgtcagagcatcagctcactgattcccccgtattgatctttcatgtgaaaggcgagggacaaattgatatcggaacagacagctttccgctgcagaaggaaacgctctacatctgtccttgtgatgagacattcaatattgcccctataccgtcaggcggcatccatttgtatatcgtcagactccgtgttttctcctattcatcagatgatgaagcgatgcttccggataacggggaagacatcttccacggacttcagcaaatgaatttacaaacggttgatcatttgacaagccggcttcagtcactttctgaaaacgtgcgatcggcggatgcattgcagaaaatgaaatatacagccgactttcagcagctgatgtatgacctttatgccgcaaaagtatgccatcaaaataatacgaaagcggcgatcgaacagacaaaacaattcatacatgctcagtccgacacaaaaatcacgctcacccagctcgctcatatggcgggaatcagtcccaagcattacagtgaaacctttaaaaaactatacgggcagagcgtaactgaatatatcacagacatccgcataaccaatgcgaaaaaactgatggccaaagcaaactgcaaactgcgggaaatcgctcatcaaatcggctaccaagacgaattttatttcagccgcatctttaaaaaacataccggcagctcacctacaagctatatgaaaaaaaggcgcacaaaaatggccgcgtacggaaaagaaacgatggggcatctgattcctctgcatcacgtgccttatgctgcggcgctgcacccgaaatggacggcctattattacaaacaattctcttccgatattccggttcacctgagtgcttaccgctataatgcaaattgggaagagaacctgcacacgctttcccaagctgccccggacatcattttcagtcttgattctgtcagtgaagaagaaaaacagcgcctgaatgacatcactgacgttttttaccttccggctcaagagaattggagagaccagtttcttcgcacagccgcatatttgaatgaagagcaggaagcgcggcactggcttaaagcttatcaaagtctcgcccattcagcgaaagatgctctgaaacacgtgcggcatcagcggttcttatttgtccgtgtatataaagaaaatatgtacatcgcccataacaacagtattgaggatgtcttcttcggtgatttaggctttgcctccgcaaaaccggaatcttttgctcctgacgaaaagatttccttggacatgctggcggattgccaggctgactgcatcatgcttttcacttgtaaagaaccggaaacgcttcgttattttcagcggattcagcagaccgggatatggcagaaccttagagccgtcagcaataaacgcgtgtttcccatatcatctgacccgtggattgaatattctccaagcggacatcagcggatgatcgagcaaagcatttccattttatccgaagatcgtccatggtaatgccggaaattatccatggtcttatccctgttcattctctataattccaattgataatagttatcaattgaacaggaggaacaatagatgaagaaattggcattcgctttcatgattttgcttttggctttcacggccgcggcttgcggaagctcagaaacatctgatacagcaagtaaaggaaaggacgcttcttcagataaaaagaaaatcgaatatctcggaaaaacatatgaagtcaaagcgccgactgacaaaatcgccattacaggcagcgtagaatcaatggaagacgccaaattgcttgacgttcatccggcaggggcaatttctttctccggcaaattcccggaactgtttaaagatattacagataaatccgtatctacgggagaaaaaatgcagccgaatatggaaaaaattcttgagctgcagccggacgtcattctggcatcaaccaaattcccggaaaaaacgttgaaaaaattgagcggcaccgctgaaacgatccctgtctctcatatctcatcaaactggaaagaaaacatgatgctgctcgcccagcttacagataaagagaaaaaagcgaaaaaaatcatcgcagattacgaacaggacctgaaacagacaaaaacaaagatcaacagcaaagcgaaacagtcaaacgcgctggtcatcagaatcagacaaggcaatatttatatttatcctgaacaagtatatttcaactccacgctttacggtgatttaggcctgaaggcgccggacgaagtcaaagcggcgaaagcgcaggaactgatttctcttgaaaaattaagcgaaatgaaccctgaccatatcttcgtacaattctctgatgacgaaaacgcagataagccggacgctttgaaagacttagagaaaaatccgatctggaagagcctgaaggcagtcaaaaaagaccatgtatacgtcaatacgattgatccattagcccaaggcggaaccgcgtggagtaaaatcagcttcttacaggttgcggctgacaaattgactcaagactaataaagagtaggtttttcacatgtatgcaaaacggcggacacacatgattatcattgcttcaccgattgccattgttctgtcactgctgctttccgttttatacggcgcaaagcagcttgacatccataccgtgttctccgcattgctgcactttaatccggagaataccgaccatcagatcatatggcattcaagaatcccgagggctgccggcgctatgtttatcggcgcagcccttgctgtttccggagcgctcatgcagggaatcacacggaactatctggcctcgccttcgatcatgggtgtgtcggacggctccgcttttatcatcaccctttgcatggtattgctccctcaatcgacatccattgaaatgatcatatactcgtttatcggttccgcattcggcgccgctcttgttttcgggctggcctccattcttcccggcggttttaccccggtgcagcttgccatcatcggaacggtgacaagtatgcttctcagcagtctgtcggctgcgctttcgatttattttcaaatttcgcaggatctcagtttttggtacagtgcgagactgcatcaaatgaaccctgattttttgaaactggccgtcccgttttttgcgatcggaatcatcacggccatgattctcagcaaaaaggtcactgccgtatcattaggagacgacatttcaaaaagtctgggacagcagaaaagaaccatcaaactcatggcgatggcggccgttgttatattgaccggaagctcggtggcactcgccggaaaaattgcctttgtcggtttggtcgttccgcacatcacacgttttctcgtcggatcggactacagcaggctgatcccatgcgcgtgcatcatcggcggcgtcttcctgactctttgcgaccttgccagccgattcatcaattatccctttgagacgcctattgaagttgtcacttctatcatcggtgttcctttctttctttatttgattaaaagaaaaggaggggatcagcgtggtgcgtaaaatggccggaatttatatcattctgattgctctcatattgctcgtaagctatttcagcatgacaagcggttctttttccgcaaagccgggtgaactgctcagtacgcttttccgcatccatccgaatccgcaatatgacattttgctgtttcagctgaggctgccgcgcattgtcatggctgctgccatcgggctcggattggggatagccggagccgttattcaggccattaccaaaaacggtcttgccgatcccggtattttgggcattaatgcaggagccggagccggaatcgtcacgtttatgcttctgtttcagggacaatctgaagcgacggcacttgcctctgcgatgggtatgcctgtcttcggcctcatcggaggattgatggcggccgtgctgatctatattttcgcctggcaccgggggcatctggaatcgggcagaattattctcgtcgggatcgccatgaattccggattcagcgcgctgtctttatttctttcattaaaaatggacccgcaggattatgagatggcgatggtttggaaaaacggcagtatctggtcggcaaactggatgaccattacggcgatccttccgtggctgatcgtgttcattcctctgcttatggcgaaaacgtcattgctggataccattcgtttcgatgaggacacggtgaaaagcctcggtgtttcaaccaataaagaaaaaacgattttactcattgcctgcatcgctttgatcagcgcatgtgtaaccgcagcgggcagcatggcatttgtcggactgatcgcgccccatatttcccgcaggctcgccgggattgagcacagatactcattaccggtcagcggattggtcggtatgctcctcgtcatatccgccgactttgcgggcaaattgttctttcagccttcagaagtgccggcgggaattattcttgcgattctcggcgttccttatttcttttttcttctgtttaagcaaaagaaggggctggatgcatgagaggcacccttacagaacaccggataaacggaaaggaatgcactgtgtatcttcctccctcctattcggttcaaacaggggctttaccctgtgtgtacgtactggacgggggttctttgtttttagaacagatggataaacttgaatcccaatttgcgaacggtacacttcccgaattgattttcatcggcatcaaaccggctgacaggctcgatgagtacacgccgtggcccgcgccttccctgagccctgcgtttcatgatttcggcggcaaagggaggctctttctcgaggagctgacaaatgtcatcattccaactgtagaagatatgcatcacatttctgcacatccggaaacaagaggcctgatcggcgcgtcattaggcggactgttttcgatatacgcgatgctgcaaaagcctgaaatattcggcagaatcggttgtatttccggttccttctggtatgaaaaatcagcagattatgtccgctccgcatctttgcgtccggcacgggggcgtatctatatgtctgtcggcagccgcgaagctgagcataaaaacaacatccaaaacaacatgatccgacaaaataaagacgtgcatgaaagcctgaggcaaaaaggcttttctcaatctcagctctctttcactgttgaagaaggcgccgtgcaccatcaagaagcattcaaacgacaattcaatgcagcactaagctggctgtacggaaaaaaccgctcacgtagctgagcggtttttttcatacttcatcacgaccggcttaagttcaaagcgtctcagcaaatagccgaacaaagcggcaaggatttgctgaaaaagcatcccgatgacgaccggaaccgccacttgagacggaaaaaaagaaacggcgagaacggctccggcgctgatattgcgcatgccccccgtataaatcagagacacaatttcatcctggctccgcttcatcagccttccgatcagccaagccacggcataacccgtcatggcaataaaaaataccatgcctgcgatgcccgcaaatttgatatccacgtgcgtgacatacggcgcgatttccgaactgttaatggcaatgacaatcatcagacagatttttgaaaaaggagacagcgaccggcttattgcctgagtccttaccggcggggaaaactggttgactatcatccctgcgatggatggaatcaccaccatctccgccagccctttcatcattccccacacatccatctgaacattcgccccggccaggacagacaggcttaacggtacgataaaaggagaaagcacggtatcaaccaggataatagacagcgtcaatccgacattccccttatacatcgcagcccaaatcaaactcgtaattccggtcggaatcaccacacccataatcagccccgtcacagttaaagggtcaccgctgaaaatcagatggccgcttccccatgcaaaaacaggcatgaaaatatgcagaacaaacaatgccatgatcatcggtagcggcttctcgatactgcgcttcagcgaatgaaaattggcactcagactgcccgtaaatgtaataaatgcaaatatccacggcacagcgccggccatccagctgatatgctgagataacagcacacccgccgccacacttgacggagtcaaaagcggcatgattctccccaacacttggttcaacttctgaagccacatcatatgcaagtctcctatatacggttttcaagtctcattcattataacaatgcaccccggcaaatttaaccgaaaaaaagcccggatatattcatccggacttcacaaattctatgccatttgtttcattaaatctcggcttttctgatttaatccctttaattcagcctcaattccgtattctttacatttggcgacaattttctcaagagccgccgctcccgaatcatcccacacgtgggcgtcggtcaaatcaatgacaatccgtttcacgtcttcatcataaacgatggcattcatgagctcagacacggaagcaaaaaagatctgtcccgttaccttataagttctgacatctttctgttcggaatgtgacacaatcttcagcttagaaattttcgccgtaaaaaagatcgcgcttagcagcacacccgcgaagacaccctttgataaatcatttgtcaggacgaccgtcatgacggtaataaccataacgatcgaatcagtaaggggcgctttccgcaaacctttaatcgatgaccagtcgaacgtgccgatggacaccataaccatcacggccaccagcgcagccatcggaattttcacgacgataccgcttaatacggcaattaaaaacattaaaaacgcgccggcggtaaaagccgataatcggccgcgtccgccggctttcgtattaatgacagactggccgatcatggcgcacccggccatgcctccgaaaaatccgttcacaatattggcgatgccttgtccgcggctttctttgttcttatcactatccgtatccgtcatttcatcaatgatctgggctgtcagcaatgactcgagcaatccgacgaaagcaagcgccagagaatacgggaaaataatccgcaatgtctcaaacgtccacggaacatccggtatcaagaaatgcggaagtgaacttgtaatcccgcccatatcaccgaccgtgcggacatccgcatggaagaccaccgcaatgatcgtcatgacaataatcgccaccagcggagacggcacagccgtcgtaaccttcggcaatagatatatgatagccagtgatccggcaagcatggcgtacatgacccatgaggctcctttgaactggggcagctgcgcagaaaaaatcaagatcgccaaagcattcacaaatccgatcatgaccgaacgcggaataaatttcatcaatttcgctatcttactgacaccaagaataaattgaataatacctgtcaaaatggttgccgcaaacaaatactgcagcccgtaatcagccaccaatgtcaccatgacaaccgccattgaacccgtagcggctgaaatcattcccggtctgccgccgaagatagaaataataatcgcgatacaaaatgatgcataaaggccgaccatcggatcgacacctgcaataattgaaaatccgatcgcctcggggatcagagcgagggcaaccagaataccggccagaatgtctttacggacattcccgaaccattgctgctgtaacgtataatctttcaaatgataacgactccttttcactataaaaatccgcaccctatcagttggaaacattgattttcatctggggaatatgaggcaagcttacggggaaaaagaggacacgctcagagtataatgtcgttgaggaaaggaattgtgaacaaagagtatcatattaaactttaaagaaatgtgcaagaccctataaataagaaaagaaaacgactctcactggagccgtttccgcttttataaaagttccggatcagacacaagaatcgtttttattgcgctgatatcctttctttcttttgtcaccgggtcgatgcccatgagatgatcaatggcttcttcataattcttcagttccgtcttttccgtaataagatcatagagctgcggaaggtcggacgcgcatgctaacgcggcttccatgatctggcgggcttcacctgtgcctacaatcgtcacgccgtttgacagcagctggtacggcctgaccgtcatctcatacgtatcatcaaagcccatcggcacgattctgcctcccttttcaataaaaggataagcccaatcaagctgattgccgattgcgtcaaaaatcacatcaaattttcttccttgattaatccgtttcacttcatccacggttaatgcttcagggtggtagacataatccgatatccggctcgccgcctcgcttcggaaactgcctatttcagtcgcaaccgtcaatcgcgccagttttttcaccatcatttgcacaagcagtccgatcggtcccgaccccaaaaccaagaccgagtcctccggctgaatcgaagccttgtccacaacattcagcacacaggagagaggctcaaccaatgtggcccgctcccattccattgaatccggaattctgtacatgaacctgtcttcccccacgtaatattccgcaaacgttccgtgcgccccgattccgagctgccaatcctcgaaggtttcgcaataacacgtcagccctctccggcaataatgacatttcccgcaaaactgcgtaggatctatcacgacgcggtctccgacttttacatttgtcacgtccggtccgatttccacgaccgctcccaccgattcatgccccataatcatatgatgggttgcattcatttttcctttcagcacatttaagtccgttccgcagataccggtgccgaaaattttcactttcacatcattggatttccgaatttgaggctcgtccacctcttgatattcaagcttatcattaggagtccagaccaacgccttcatatttctcttcctttctgccccagcggatttggtctaacaatgtttgatgaagctccttcgttgatgccgcaatacatgattgctgattctgataacttaaatctgtcagaagcgtttcgtccaaagaccggccgtacgcatccgtaatgaccactcccgccttcttcgccaaaaagacgcttgcggcaatatcataaggaaacaaatgcagcacctctccgttcccgacctgctgaaaatctgaaagcagcttcggatcatctttcagcagacgattgccgatatccacataagcatccatctgccccgtgataattcgtgaaatcgaataagaagcgctgttgaaaacaaaaaccccgccattattggccgactggtcaatcagatggccgtatgcgtccgtcatcagctgcgccggatgcccgttaaattcaaggctccaaaacatatttttaatatcccgcactccgctcaaattcggcaattctccatgatacccttcaaaatgaatggcatcgctgtatatatcaccgtacatataagcgcctgatttcaattcaagtaaaaaagcaaactcgatatccttaatctttgcgtttggcttatacgaagcaagcgcaatcgaaatacacgacatttcaagtcctgcggcggccgggcgcgttccgtctatcggatctacaattaaaatatattgcggatcttctccaatcagcttcaggccgccatcctccgtgtaaaaagcaaccggatggcccttttcttgaatataatccagcaccgcctcctcagcagcggcgtctatgttaaattgggcgtcgcctcccggagaatagccatttacgagccggtttttcagcgtgcctttttgatttttcaccttttgataaacaaattgtccaagctcaatgatatagtctctcacttgatttcctccaatagcttgcgaagtctgtagcagagcacttcggcttcactaagtgttatggttaaaggcggacggattttaaagacatttccgaatccgtaacgggatgtccggagaatcagcccgtaatccattgcccgttttgcaatataattggtcagctccacatccggttcattgttctctttaacaatctccacaccgatcataagaccgacgcctcttacctcagaaataaaagcgaaatcctctttcatcgtttctaagcgatccataatataatgaccgaccgtcgttacattttccaaaaatcccggtcgctgcatgatatctatggttttacaagcggcagcggcggccatcacatttgagccgtatgtgaaggagtgcgtataccccggaagcccggtatacttgtcctccgtcagagtggcggcgacttggaaacctgtgcccccgagcccctttgctaccgtcatcatattaggtttcacatcgaagtggtccgcggcaaacattttacccgtccgtccgaacccggtctgaatttcatcaaaaatcagagcgatatcatgttcatcacaaagctgtctcagctgtttaaaatactctttaggcggaacgacgtttccaccgtttccggatatcggttcaataatcatggcggcaatttttccattgctcgcatactcaataaaatcattaattctttctacgcacagcataccgcatgaatcaggtttctgattataaaaacagcggctgcaatagggatcggggacttgcaggccaaaagaaatttgcggcgggaaaggttcttttctgaatgagttgccggacaaagcggaagtcatatacgtttgtccgaggtggcttcgaaataaggagatgacatcggtttttccggagtaatactgagccattttaatagctccttcatttgcaccggaaccgctgctgactttagggtgtacttttgtgagattatcgggggcgatttctactagtttttctgccagtttatttacggcgtctgtttgaaaagatgatgttacatggatgagcttatcggcttgttctttaaccgtatcaatgacctctttgttaccgtatcctaaattcaagttaaacgtggcagaggcgcaatcaatgtactcatttccctcttgatcgtacaggtaaatcccttctccgcgctccattactacatcgtcaacactgtaatacaagctgtctggattcgtgatttccttcgttcccacaaataccacccctatgaaattattagaatttcgctttttatcgtataaattattgaaaataatgtcaacgatctttcttgtaaaaaatgttaacaatttgttaacgttaccataatggatgtacgagaaaaagttatgtgatatagtaacaatacttggattttttgtaaaaacatcatgtcatacgagtagagagaaatatgattttaccaataaggagataaaatgatgaaaactcgtctgctgtggataagctgtttttcttatggatcgattgcttttacacttgttattctgggagccgtactgcctgagttactcacacattattcacaaagctacagtaatggcggagtattggtattctctcagttcatgggctttctcatcggtgtcatcggaatgccatacatggtgaaaaagcttgggcgcaaaaacgtcgttatctttggcctggcactcatcagctgtgaaatgttcatcaccttcctgccgccctggccgctgctctttcttctcgtcagcatcgcagggcttggcgccggattggtggaatcctgtgtaggcacgatcatcctcaccgctattaaagaaagacaggctgtggccatgagcaagatggaagtggcctacggattaggtgcgctgttcatgcctctgctctcaggctttcttatcaacaaccacatgtggacaattgcttttttagtattagggttatccagttttgcactcttaatcgcatggaagcagatgagtttcggcagtattgatcagcttctcatccgcaaagaggtctcttccgatgacactaaaaaacaaagcaccggttatcggtcacacggattgctgtttattgccttggcgggtgcttacttcttcttttacggcggcagtgaagtttccattgtacattttatcccctccatcttcgctgagaaatgggatatccccaactctttggcaacgataacagttactgtgtattggacggggatgatcataggaagattattaacaggcccggtatcagaaaagctgacatatcaccgttatctccgtctcataagcattggcggtctggctgcacttactgtattagcattaagcaaaaacgtatggttcggttttgccctttgcttctttttagggctgttcatggcaggcatgtttgcaatagccctaatcatcacgaatcatttttatcccggaaagacagaaacgactaccagtattctgctcgcttcaaacggattaggaggttcactccttccgatcgccgtcggctggagcttagatgaatatcccgtacaaactgcgttctggctgtttactgcactgatgctccttatgctgctgattgtgttcagtttaagaatgctcgagacaataaaatcaaacaatcttcaacatcacaacagcaaagcaaaatcaatgtaaacaaaaaagctaatgcctttcaaaggcattagctttatatatctatgtgatctttcatataaaaaaccaagttcatcatgaacttggttaagatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttacgttgttcccgaagctttttgttgttgtctgctgttcatcagcgacgtttaataatataccacggtgtctctctataaatcaagcatttttttaaaaaaggagaaaaaaagaaaaccagtatattatctttaaagtttgagaatggtcgggaagacaggattcgaacctgcgaccccatggtcccaaaccatgtgctctaccaagctgagctacttcccgatttttaaatatattatggcgcgcccgagaggagtcgaacccctaaccttttgatccgtagtcaaacgctctatccaattgagctacgggcgcaatcaatttcacaatatcccgttgggataaaatggagcggaagacgggattcgaacccgcgacccccaccttggcaaggtgatgttctaccactgaactacttccgcaagtaaaaatgtaatgtacagccagaatacagcatcagataacccaaaaactgtattgttatttattcagtaaaactccaaacggtataacccgcagattaatctaaagcatactgttcattatgacaaaagtaattatatcaaggttttgataaaagtcaataccgtttaacaattaattatgttaatctcttttgcatccttaaagaaaggcttcatcagaagacgcgctaaatacctataccttaactgatacaatcagcaacagatttttactgaactaaacaaaaaataacagtcccataacaagcggaaactgcttcagatcaacgtatttagataagcttccaagcgggctcgaaccgctgacctcttccttaccatggaagtgctctacctgctgagctatggaagcaatggctccgcaggtaggactcgaacctacgaccgatcggttaacagccgatagctctaccactgagctactgcggaatattataagcttcataaacaaaaacatggtagataaaataaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttacgttgtttccgaagctttttgttgttgtctgctgttcatcagcgacgtttaataatataccatgcattctttaaatttagcaagtgtttttttcgttttttttaaaacgtatttcgttatattcatctccgccgcggcatacgatgtaatcaagcatggacaagataaggaggcgtcatcagtgaatcacttctacgtgtggcacatcagaaggataaaacagctgcttattattatcattgccgcatttgcagcagccagctttttttatatacagagagccgtcccccttcctgtatttttaactgatagcggcccaaaggctatttcaaaaggggagacgagagcgggggaagtcgcattaacattcgatatcagctggggcgatgaaaaggcggttccgattctgaacgcgctaaaagcaaacggtattaaaaacgctactttttttctgtcagcttcttgggcggaacggcacccggacacagttgaacgtatggtaaaagacggacatcaaatcggcagcatgggatatgcgtataagaattataccaacctagaggacaatgaaataaaaaaagatatcctccgggcccagaccgcatttaaaaagctgggtgtgaagaatgttcatttactccgcccgccgaccggacaatttaataaaaaggttcttaccattgcacagcagtaccactattcagtggttcattacagcgttaactcgcaggattggacaaatcccggccctgataaaatcattgaaaatgtaaacagtcatataaaaggcggcgacattgtcctgctgcacgcatctgattcagcaacacagactgaagaagcgctccccgccatcattcacaatttaaagcaaaaaggactgaaaaacgtgaccgtcggcgacctgatcgcaaatactgacgtcaagtcatcagaagtgaaataattacctctgggcaaacttcggcagcattaacagctgaaacgcattgcagcccatcagcggaatcagcatcaaataaagccagtcctcattattcactcgtagcgcaggaacccattcaagcgctgtaataacgaccattaaaaataatgatgaaacgaacgtattttttgaggactgcttttgttttatatacgccgtcaacaggccgacggcaagcagagccagcggcagccagacaaaccccgcaatcgagtcatcccgctctccgaaaaacaaaaatctgacgtacattaaatcaaaagcgacaaacagaatgataaacagctgaagcagattccaaagcgagcttgatctgagaatttcaagggcaaaccggtgcaccgtcagaaaaacgaagaatcccatctggctgatcacactgaaaatcatgcccaccccgataaaccagatcagaacggagaaaatctgaccggcctcaaaattcagaaagaaccccttgtactccccccacttcagagcaaatcccacgacgcttgtaataagagcgcccacagctaaaatcgaaaagaaaaatcgaacaagcccgcggcttttcatctcttattcatccccctgacaatcgcgttcagcgatattttgttatgtataaatccattccgatgaatcatattaaaaataagtacaagtaaggaaggagcttatgcatgtcaaaagccaaaacgctattgataagctgttttgttttattatctgtaacagcttgtgctccaaaagaccaagcagcggatatggattatgaccagactaaaaaaatggttgttgatatattaaagaccgatgatggaaaaaaggcaattaaggaaatattaaatgatgatgcgatgaatgaggcattggtgattgatcaaaatgccattaaaggcacaatagagaaaaccctcacctctaaaaaaggggcggagttctggaaaaccatttttgaagactcaaaattcgccgagagctttgcaaaaactcttcagcccgagcatgaaaaaatcataaaaaaactgatgaaagaccctgattatcagaaaagttttatgcagatcatgcaggaccccggcatggataaaaaatactatgagctggtgaaaagccaaaagttccgcagttacttagaagatgtaattacagagacactttccagcccgcttttcaaaaagcaattcgaggatgaattgaaaaaagcagcttcaagctctgaaaaagaaagccaataaaaggccgggccgtgttgatcccggccccttttttattcagctgttttttcaatgactttctgggcgatccccatataaatttccccgatcggatgacttctgtcatagacagaaggcgcaaactgatccttgtcccaatcaggctgttttaaaggaattctgccaagcagcggcacttgcaattcctctgcaagcttatctcccccgccttgaccgaacacatattctctctcgccggtttttgcactttcatagtaagccatattttcaatgacccctacaacttcatgatcggtcttaatcgccatagaacccgctctcgccgctacaaatgcggctgtagggtgcggcgttgatacgataatctctttgcagctcggaagcatcgtgtgtacatcgagcgccacatcaccagtgccgggcggcagatcaagaacgatatagtcaacctctccccagtcaacttcatggaagaagttattcagcatcttgcccagcatcggccctctccacacaaccggagcgttttcttcgacgaaaaagcccatcgacataacctttactccaaatctttcgacaggaagcagtttttctccttctactgtcgggcgaactgtaatacccatcatgtccggcacgctgaatccgtatatatccgcatcgatcaagccgactttttttccgagccgcgcaagagaaatggccaggttgacggaaaccgttgatttgccgacaccgccttttccgcttgccaccgcaagaaagaccggcggatgtttcctattcagcagggtttcgctttcagcagccggccggctgaatttcgccaatgtttcttccggcagctcttcaaaccgcagtcccacagtttccgcacccgcttctttcagaacggatacgatttcctgctgaatacccatctgttcagccgtccccgtttttgccaatgcaattttcacactgacatgccgtttttccggcttgatctttacttctttaatggcatccaattctcccagcggtctatgaagaaaaggttcgcgcatgtttccgactatatttcttacttcatcttctcttatcatcgaaccctcaccctttgtgtattcgtttacaaatggtattataccatatattaaacatagaatcggcgaaaaaccctccttactcgggagggtctcctttctctgtgaagtatctcaatacgcccttatacacggaagaagcgattttgtcctgatatttgggctggccgagccttttcgcttccgcgggattggacagaaatccgatctccaccagcgcgcccggtttggttacattctgcattaagtaaatgccgtgtatccgtttcgcctttctcgttgtattctccaaattgattctcaattcgtcctgtatatattttgccactttttcattttcttcgtattttccatagtagaagctttgggcgccgctccatctcggtgacggtatggcgttcagatgaatgctgatataaagctccgcctctgaacggttgatgatttccacgcgctttctcagatcttccgctttgcgtctgctgtagcctttcgtcccttcaggagctaaatcagtatccgtctcccgcgtcataatgaccaaagctccctgctcctgcaaatagtctctgaccctggaggccacttcgagagtaatgtccttttcaaggtgactgcctcccgtggcgcctccgtccggcccgccgtgtcccggatcgagatagatgattttcccgctcagcggcagactccacggccgccaggaatcatcattatggaattgaaaccggaataaacacaataatatgataaagccaagtaaaaaaccgagccatttcagcttttttgtcatacctttccctcccgcttgtccccgttattaataagtatgggacaagggaagaaattatgattacctcatgcggagcttacattgtttttctctttgcagaaatccttccgtccaccagctgttgataaaccggcaggacgcttcatagatttctttttgttcaacggaagaatattgctcatgcgtccaattgcaaagatattcaaaaaaatcgaccgtcagttcttcctcttcttcagccgaacgggcgtttgccctctgcaaggactcaccataatagccaaagacgccgaaccggccgcctaataaatacgcttcaattgcaaaatctatgcatccttcactcagaatgccgttttcgtcttgaagaaagggaaacaaaggggtaagacatgcttttacggactgaatgatctgcgtcagtgacagctcctttagtaaactcttctcaagctcaaaatccttctgccgtttcacgtctgaaaaagataatacttctgccattgccagccacgctcctttttactgttattttgaaaggaaaagggaaaaagcatgctttgttgatagtggaaatcctcccaaatgaaggagttttatgttaactggaagaagaaagagctgaggtgacgtgatgaaaaagctgtttcaatacaattggacggtgcgtgacgagtggtttatgatatgtgaaaagctgagccgggaggaactgacgaaaacccggacgggcggaatggagagcatcttgcggactttatttcatatcattgatgtcgagatcagctgggctcgtgccattttaggtaaagatgatgttttacctgctgagtctgactatacaagcattcaggatctcagaaagctgtctgaacagtatcgggaggatgtcattcatgcggtctccctcaaaggaccggatcttgttaagccggactggatggaccaaacctttcctaaagaagatattctccgccacatccttgcgcatgagattcaccatatgggacaactgtcggtttgggccagagacattggaatagaaccggtttcggctaatgtgatcagccgtccgcaggaaaaagccgcaaaaaaacagcacctctgacgggatgccgtttttatattttaatgcttcttgttacggagtatgtattaatgtattcatccagcacgaggccgcctttgtcctcgtaaaaaccggcaaccatgaagcctgcgtcaatctgacctttaatttgatcctccagcgtatggccgaattcaagcgcttcatgattatcaataagttcctttacctttttcttactcagatctttttcatccgaaaacggaatggaatactttacttttagtacgccttcctgctctaaatccatatcaaataagaacacgacgggatttacaaaaccggagactaaagacccgccttttttcaatacgcgatgagcttctttccataccggaagaaccgtatcaacaaagcaattcgataccgggtgcacgataaaatcaaatgactcatcatcaaaacagctcagatcattcatgctgcctttgacagtccgaagcgtaagatcgtcccgcccggcaaccattctgtcttgcgcaagctgtttttccgaattgtcaaagatggtcacatccgctcctgcagcagcaaggaccggcccttgctgtcctcctcctgaagcgagacaaagaaccttcagaccgtctatgggcggaaaccaatcagccggcacatcttttccgggggtcattctgatgctccaattgccttttttcgcttcaccaatcgtatgagaatcaaccgcaaccgtccattcattgcctgtttcgacttttttatcccatgccttgctgttatgtatgactaacttattcattataactgcgctccttattggtaatgaatagagtataacaaacaattctagaaaaacatcggataacctcttgaatatgagaaaaaaatacaaaaaaaccacaaccaaaaagttgtggtttttgccatccaaaacgattaacgttttgagaactgaggtgcacgacgagcgcctttaagaccgtattttttacgttctttcatacgagcgtcacgagtcagaagaccagcacgtttaagtgttgcacggtattctggatctgcttcaagcaaagcacgagcgataccatgacggattgctccagcttgaccagataagccgcctccatgtacgtttactaaaacatcataagtaccagctgtttcagttaaagttaatggttgtttgatatcttcgattagagctggagatggaatgtgctcgctgatttcacgattattaacgacgatacgaccttcacctggaactaagcgcacacgcgctacagaacttttacgacggccagtaccgtaatattgaacctgtgccaaattggtaacctcctttttaattaaccgcgaagttcgtaaacttcaggtttttgtgcttcatgtggatgctcagaaccacggtatacgttcaatttcttgaacatttgacgacctagagaaccttttggaagcatgcctttgatagcaagctcaagcattttctcagggtagtttgtacgcatttcaagagcagttcttgattttaatccgcctggatgttgagtgtgacggtagtagattttgtcagttaactttttaccagttaactcgattttttcagcgttgatgatgatcacatgatctccagtatcaacgtgcggtgtgtaagtcggtttgtgtttcccgcgaaggatagatgcaacttctgtagaaagacgtcctaaagtcttgccagcagcatcaacaactaaccacttgcgttcaatagtacttgcgttagccataggtgttgtacgcattgaatttccctcctaaatgatctgtcattttcaataatcttcgattacgttctatttcacaacacaataagttccggggcttatcgtggggttgaaatacataccatatgatatcttataactttatgcagactctgtcaagaaaatgttacacctggtttagttgtcatagcaaacgctccataaatacagcccgtgccccggtgcggtgcgccccgcggcttcacgatccttcgcttcgagcattgcttttacatcatcgggagaaaattttccagctcctgtatccaataacgttccggcaatgattctgaccatattatagagaaaaccgtttccggtgatccgcatctgcaggccgtctccggtctcagtccaatccagctcgtaaattgttctgactttatcctgaaccgcggtatcagccgcgcaaaagcttgtgaaatcatgtgtcccgacgaggtgccttgaagcttccctcattttctgcacattaagcggatatgcaaaatggtaagcgtaatgtcgtttaaatacgtccgggtgtttctccgtatatacaaagtagcgatattccttttggaccgcgctaaatcgtgcatggaacccatcatccgcaatctctgctgttttgacggcaatatcatcaggcagcagggcattgagcgcaaacggccatttctcagccgggatggacagcggcgtatcaaaatgaatgacctgcccggcagcatgaacatcgctgtccgtgcggccggatgagatgacaggcactctgccgtccgttttatggatgacggccagcgctttttccaattcactttgaacggtccgctttccaggctgaacctgatatccgttaaataaatgcccgtcataagcaatggtacatttcactctcattcagcagcacctctaacttcttaagaaaaacaataacacggctaataccatgatgagcagaatagctccggtatcctttccggtccagacgagctttctgtatttcgttctcccctcaccgccctggtagcctctcgcctccatggcgaccgcgagctcttccgcgcgtttaaaggcgctgacaaacagcgggacaagcagcggaacaaccgctttgattctgtctttcaccgggccgcttgtaaagtccgcacccctcgccatttgcgccttcatgattttatctgtctcttccatcaatgtcgggataaatcgcaatgatatcgacatcatcaatgcgagttcgtgtacgggcagcttcacctttttaaaaggattcaggagctgctccattccatccgttatttcaatcggcgttgttgtcagcgtcagcagcgtcgtcataaagataaggtaaacgaaacggagggagataaaaataccctgtataagtccgccctcatacactttaaaccagccaagctgaaaaatgacagatccttcatgcgtcatgaaaatgtgtaataaaaaggtaaacgccacaatccagataatcggcttaagccccttcagcaaaaagctgaacggcacgcgagtcaaggcgatcaccccgaatgtaaacaaaccgagcaaagcatacgtctgtacgttgtttgccaaaaagacgatacatacaaaaagaaaaatgctgacaagttttgttcgcgggtccaatcggtgaataagcgatgatccgggaacatactttccgataatcatgctgtccatcattggtccttttcctcctgaaagaaagccttaatttcactggcggcatcctgcagggtcagcatgggtttttcacacttgactccgagagccttctcaagccgtctctgaaacttcaccgattcaggaagatccagtcccatttcggccatctcttcaccttttacaaacaagtcacgcggactccccgtcgctttaatggttcctttgtgcatgacaatcatttcgtcagcatagcgggcggcgtcctccatgctgtgggtgacgagaacggtagtcaggtttccccgctgatgaagcgcatagaacatgtccataatgtcctggcgccctctcggatcaagaccggccgtcggttcatccaaaaccagcacttccggctccatcgcgagaacgccggcaatcgccactctgcgcatctggccgccgctgagctcaaatggtgaacgatccaaaatgtcttccggaaggcccacaagccccagcatttcttttgctttccgttcagcgtcttctttttttacaccaaaattcatcggtccgaatgcgatgtccttcagcacagtctcttcaaacagctgatgttcgggaaattggaaaacgattccgactttttttcgcaaagtcttaaggtctttattctttttaccggctgccagaatcgtactcccgagttcaaactgtcctttagtcggtttcagcaaaccgtttaaatgctgcaggagcgtcgatttgcccgaccctgtatgcccgatgacggcaacgtagctgccctcttttatcacggcattgatatcatacagagccagccgttcaaacggtgtcttcatttgatagcggtgttctacatctttgattttaatgtccacagctcattcaccagcccttcctgagtcagatggtttttcgttaacgccagtccgctttctttcaaaagcaggctgagctggaatgagaaaggcaaatcaagaccgatgcgaaccaagtcttcgtttaatttaaaaatctcttcaggcgtgccctctgcatatttcctgccgccgttcatcacaatgatcctgtccgcccttgcggcttcttccaggtcatgtgttatcgaaatgacggtggccatgccctgatcttttaagcgtctgacagtatcaaggacttcttctctcccaatcgggtcaagcatggatgtcgcttcatccaaaatcataatatcaggacgcgcggcaataatccccgcgatcgccactctttgtttttgacctccggagagatggtgcggctcttgatcaagaaaatcctgcatattgacttgtgtgacagcccaatctactctctcaatcatttcttcgcgcggaacaccattgttttctaaaccaaaagccacatcatcgcgaacagtcgttccgacaaattggttatcgggattctgaaagaccatccctattttttttcgcacatcccacacggtatcctcagtcagtttgatgccgccgacttcaatttctccggcctcgggcaaaatcagcccgttcagcgctctggccaaagtcgacttccctgaaccgttgtggcctacgatagcaagccattctccttcgtatacctccagactcacaccgtccagcgccggtctttctgcatctttgcggtaacggaatagaatgtcttttacggatataagctgtttttgatccacgggcgcctgacctcctctcagctatagctctgcttttctgtctcatgatcaaaagttctgatatctaaaaaaagggcatagatccagttagaaactgtcccgcccttctttagatacacaaaaatatgtgattaaaccaattcgatgattgccattggtgcaccgtcaccacggcgaggaccaagcttcataatacgtgtgtatccgccttggcgctcctcgtaacgagttgcaatgtcagagaataatttttgaagtgcatcttggttattttcttcattagcaacctcgttgcgaatgtatgcagctgcttgacgacgagcatgcaagtcaccgcgcttaccaagagtgatcatcttttcaacaacagagcgaagttctttcgcacgtgtttcagttgtttcaattctttcgttgatgatcaaatctgttgtaagatcacgaagcatagctttacgctgtgaactcgtacgtcctagttttctgtatgacatgtgatgtcccctcctttaatggaatgctgtttctaaataaaaaacacacgaaaatcctagttcacatggaaactagatcaatcgtctttgcgaaggccgagtccaagttcttctagtttcgctttcacttcttcaagtgatttgcgtcccaggttgcgaactttcatcatatcttcttccgtcttgttcgcaagttcttgaaccgtgttaatgcccgcacgcttcaagcagttgtaagaacggacagaaaggtcaagttcctcaatcgtcatttcaagaactttttctttttgatcctcttctttttcaaccatgatttcagcatgctgagcttcgtcagttaaaccgacgaatatattaaggtgttcagttaaaatctttgaaccgagagcaattgcttccttcggtccagtgcttccgtcagtccaaacatcaagtgtaagtttgtcatagtttgcaacctggcctacacgagtgttttctacctgataagataaacgagaaactggcgtaaagattgaatcgatcggaatcacgccgattggctgatcgtctcttttgttcgaatcagcaggtgtatacccacgtcctctttgtgcagtaaggcgaactcggaaactcgcattctcaccaagagtcgcaatatgaagatctggattaaggatttcaacatcgctgtcgtgtgtaatatcagctgctgtgacagttccttcgccctgtacatcaatttcaagcgtcttctcttcatcagagtagattttcaatgcaagctttttaatgtgcaagattatcgttgtaacatcttccacaacgccttcgattgtcgagaattcgtgcagtacaccatctatctggatcgatgttacagcggcaccagggagtgaggataagaggatacgacgtaaggagttacccagagttgtaccatatccacgctcaagcggctctacgacaaacttaccaaatttggcatcgtcgctgatttcaaccgtttcgatttttggtttttcaatctcgatcattacttaaaaccctccttcaaaacgtcgaaacctcgaatagaatcatatgagattccatccgaaattccccattgtttagtcccgtatgtgctcaggcaacgagtcggtgcattcgtttcataaataactgtatcataacccattattgacagggacacaaaatctatacaaacaaattacacgcggcgacgttttggtggacggcatccattatgaggaacaggagttacgtctctgatagctgtaacttcaagtccggcagcttgtaaagcacggattgcagcttcacggccagaacctggtcctttaacagttacttcaagagttttaagtccgtgttcgattgaacctttagcagctgtttcagcagccatttgcgcagcaaaaggagtagatttacgagaacctctgaatcctagagctccggcacttgaccaagaaagagcattaccatgagtatcagtgatcgtaacgatcgtgttgttgaaagttgaacgaatatgagcgattcctgactcaatattctttttcacgcgacgtttacgcgtgttttgtttacgagcagcagccattgtttaggtacctcccttacttattttttcttgttagctacagtacgacgcggacctttacgagtacgcgcattgtttttagagttttgtccgcgaacaggcaaacctctgcgatggcggattccgcggtagcttccgatttcgatcagacgcttgatgttaagagaaacttcacggcgaaggtcaccttctactttcagtttgtcaataacatcacggattttaccaagttcttcttcagtaagatcacgcacacgagtatcttcagaaacaccagcctctttcaagacttgctgagccgttgtgcggccaattccgaagacatatgttaaagaaataacaacacgtttgtcacgtgggatatctacaccagcaatacgagccattctctgggcacctccttattaattatccttgtttttgtttatgctttggattttcacagatcaccattacttttccttttctgcgaataactttacatttctcgcagattggtttaactgatggtctcactttcatgtgtttccaacctccttcagtttccggagtgctttatttgtaacggtacgtaatcctgccacgagttaagtcatatggagataattctaccgtaactttgtctccaggtaaaatgcgaatgaagtgcatgcggattttaccagatacgtgagccaaaaccgtatggccattttcgagttcaactttgaacatcgcgtttggcagtgtttcgacaatcgtaccttccacttcaattacatcgtctttcgccattcaagtgttctcccttcttcaaatcagtaacttgctctctgacaaatttcaaaagagaaaatctcagttatccgtttgtcacacgccctgtttcgtttatactgttctgaacttccggagatacgcaatcataaagggtgaatgattgatattctatttctaaggagaatgaaatgtacgcttttctccgtctgctttagtacacgatgatgaatcttcattccggtgacagcagctagccggtttttcttccgaccaattgtaaacctacaatctgcccaggtgcggaatgaaaaacatgtgtcatggaattcatttcatcatctagacttttgtcagtatatcaaaacccgtttccgtaatcgcaatcgtatgttcaaaatgagcacactttttcccatctaccgttacaaccgtccagttatcagccaatgttttcacatatcggctgccagcgttaaccatcggttctatagcgagaaccataccaggcttcagcctaggtcctttgtttggcggaccgtaatgaggaatttgcggatcctcatgcaagtcttgaccaacaccatgtccgacatactccctaacaactgaaaactgctcattttcgacatacgtttgtattgcgtgggaaatattcgacaaacgttcacctggttttgcttccttcaagcctttatataaagactcctctgtcacttccagcagtcgtttatcatcatcactgatgtttcctaccggatatgtccaagcagagtcaccatgataaccatttaatttagcaccgatatcaatgctgataatgtcaccgtcacgcaaaacccttttaccgggaattccgtgaacgagttcttcattaactgatacacagatgctcccgcgaaacccattataccccttaaaagatgggattgcaccctgcttctcaataaaacgttcggcaatttgatccaattcttttgtcgagattcctggtttaatgtgctttttcatctcttcatgagtcaaagccacgattcgccctgcttcccgcatgatgccaagctcacgaggggtcttacagataatcatttgctcaatcctccaagaagctctttcacatctttgtacacgtcgttaatgtcctgctggccattgacgttgacaagataccctttctcagaataaaaatcgagtaaaggctgagtctgcttcatgttgacctcaagccgttttgagacggtttcctcattatcatctgcccgttgataaaggtctcctccgtctttatcacaaacacccggcgttttcggcggattgaaaaccaaatggtaggttgtgccgcaaacactgcaaattctgcgtccagtcaaacgttccattaaagagtctttgtctactttaatgttaatgacataatcaatcggcttgccgtattcctcaagaatgttttcaagagcttcagcctgagcgactgttcgcggaaatccgtccagaagaaaacctctttcacaatcatctttgccgagtctttctttgacaatgccgattgtgacttcgtccggtacgagctcgcctttatcaatataagactttgcttcgagtccgagtggtgtttcttctttcatagcagcacggaacatatctcccgttgagatatgaggtatcccataatcctcaacaattcgttctccctgtgtgcctttaccggctccaggaagtcccattaagactaagttcattcggatttcccccgtcctctcttattaagaggaatggttaaaaccagtcctctaatttttcataaatcctcggtaattacgtttcactaactggctctccagctgcttcattgtctccaaggctaccccgacgacaattaacaatgatgttccgccaatctgtgcactttgaggcaatccagcgaattgaatgaaaaagataggaagaatggaaatcacggctaagaatatagaacccacaaacgtaagtcgatacaaaatgctcgtaattctatcttgagtcattttccctggacgaacccccgggatatagccaccctgttttttaaggttatcagccatttgttcagggtttacctgcacaaaagcatagaagtacgtaaaggcgataattaatgcgacataaaccgccatgcccaccggatgtgtattgtcaaagttggcttgaatccactttgtcacatcgttctctccgaaaaatgacgcgatagtacgcggcgtaataagaaacgcaaccgcaaagattaccggaataacccctgccggattcactttaagcggaaggtgagttgactggcctccgccaacaggtgaacgaccttgcccttttgcatattgaatcgcgattttgcgtacggcctgctgaatgaaaataacaccaacaataacggccaaaatcgcaatcaccaataaagcgatttttacaatatgaataaacagctgatcgctgctgccgacaaattgagtctcataaatctgcccaacagttttcggaatactagccacaatccccgcgaagatgatgatcgaaattccgttacctactccattggaagtaatttgttctcccagccacattaaaaaagcagttcctccagtgagtactaaagcaataatcagatatgtcgatatgccggatttttcaatcagcataccgtttgccaggttgttaaacccgtaagacatacctaatgcctggataaaaccaagcacaatcgtaaaatatctcgtgaactgagctaatttacggcggccgacttcaccttgcttagaccactcggtaaacttcggcacaacatccatctgaagcagctgaatgatgattgaagcagtgatgtaaggcgtaattcccatcgcaaatatggagaactgataaagcgcaccgccgccaaatgtattaaggagatcaaaaacccccatcgaactttgtgtctgcaacgcctgagcatttacatatggcacagggataaacgcacctatgcgaaagacgataagcatgagtaatgtaaaaatgattttattccgaatatcactcacacgcataaagttggagattgtcttaaacaagttagatcacctcagctgtaccgccagcagcttcaacagcttctttcgcagaagcagagaatttattggcttttacagttaattttttctctaatttaccgttgccaagaatctttactcctgcattaagtttgctaataacaccagtctcaagaagaagttcaggagtgacttccgttccttccgcaaaaccgttcaatttgtctacgttcacaatagcgtaatccttacggttgatgtttgtaaaaccgcgtttaggaagacgttggaataaaggcatttgtcccccctcgaatccagggcgtacaccgccgccagaacgagcgttttgacctttgtgacctttaccagctgttttaccgttaccagaaccaataccacgacctacgcgattgcgtactttacgtgaaccttctgaaggctttaattcatgaagtttcattaggacacctccttagcctataatttatttttattgttctttaacagaaactagatgagacactttattaatcataccgcggatcgcagcgttatcttcatgaacgacagtttggtttgttttctttaaaccaagtgttcttacagtaacgcgctgatcttccgggcgaccgattacactgcgtttgagggtaatttctaatttagccattaatgttccctccttatcctaacagttcttctacagattttccacgaagcttcgcaacctcttcggcacgtttaagctcacttaaaccttgaagtgttgcacggatcatgttgatcggtgtgttagaacctaaagacttagaaaggatatcagcaacgccagcaagctcaagtaccgcacgtacagggcctccagcgataactccagtaccttcagaagcaggtttcaacaagatattgcctgcaccgaaacgtccgatgatttcgtgtggaatcgtagttccaaccattggtacttcaatcaaattctttttcgcatcttcaacagctttgcggattgcttcaggtacttcttgtgctttaccagtaccgaaacctacgtgaccgtttttgtcaccgacaacgactagagctgcgaaacggaaacgacgaccacctttaacaactttcgctacgcggttaaccgtaactaagcgttcttctaactctaatttgcttgggtcaatacgacgcataatcatgtgtccctcctttttttattaaaatttcagtccggcttcacgagctgcatcggccagagcttttacacgtccatggtataagtatccgccgcggtcaaatactacgtcagaaacacctttctcagaagcgcgtttcgcaacgagttcaccgactttagcagcagcagcgctgtcaccagtgctttccacgttcaaatctttatcgagagtagaagcactagcaagtgtaacgccatttacatcatcgatgatttgagcataaatgtgtttgtttgaacggaacacattcagacgaggtctttcagctgtgcctgaaagtttagcacgaacacgggcatgtcttttttgacgagcagcatttttgctagttttcgtaatcatccttaggtcactcctttcttcactttaagcggtcttacttagcagatttaccttctttacggcgaacaacttcaccttcgtagcggattcctttacctttgtaaggctctggagaacgtacagcgcgaatgttagcagcgatagctcctacacgctctttgtctgtaccttttacaactactttagtttgagaaggaacttcgatttcgatgccctcttcaggaacgatctcaacaggatgagagtatccaacgtttaaaacaagtttgtttccggatttagccgcacgataaccgacaccgactaattccaaacctctttcaaatcctttagatacgccttcaaccatgtttccaagcagactgcgagtcgtaccatgcagcgcacggtgctctttgtgatcagaaggacgagtaactgtaagcacgttgtcctcaattttgatttccatatcaggatggaaagtacgagttaattctccttttggtccttttacagctacagtgttgccttcgttcagcgttactgtaactccagaagggatctcaagcagttttttacctacacgagacatactaaaacacctccattcttgttaaacttcttaccaaacgtatgctagaacttctccaccagcttgttttgcacgggcttctttgtccgttaaaacaccttgtgatgtagaaataatcgcgattccaagaccgttaagtacgcgaggtacttcatttgatttagcgtatacacgcaaacctggtttgctgattcttttaagaccagtgataacgcgctcgttgttttgtccgtatttcaagaaaacgcggatgataccttgtttgctgtcttctacgaactcaacgtcacgaatgaaaccttcacgctttaaaatgtcagcaatttctcttttcaatttagaagcaggaatttcaagcttctcatgacgtaccatgtttgcattgcgaatacgagtcagcatatctgcaattggatctgtcataaccattatataattacctccttcccattcttggggattaccagctggcttttttcacgccaggaatttgtcctttatatgcaagctcacggaaacaaatacggcaaagtttaaatttacgaatgactgagtgcggacgtccgcagcgttcacagcgagtgtactcttgcactttaaactttggtgtacgttgttgtttcgcaatcattgactttttagccacgatttcgcctccctttcattgattatttctggaacggcatacctacttgagttaatagctcacgagcctcttcgtcagagttagcagtcgttacgataacgatgtccattccgcgaacctttgttactttatcgtagtcaatttcagggaagattaactgttctttgataccaagagtgtagtttccgcgaccgtcgaaagatttcttagaaatcccgcggaagtcacgtacacgcggtaaagatacagaaataagtttatcaaggaaatcatacatgcgctctccgcgaagagttactttcgcaccgataggcattccctcacgaagacggaatccagcaattgatttcttcgcacgagtaacgacaggtttttgacctgcgataaacgttaattcttcaacagcactgtcgattgcttttgcgttttgaacagcatcaccgacacccatgttgattacgattttttcgatttttggcacctgcataacagagtcgtagttgaacttcgtcattaaagcaggtgaaatttctttattgtacttttctttaaggcggttcatgagatagacctcccttcctttaaatactatttatctaagacttgcccagatttttttgcaacacgaacttttttgccatcttccactttgtatcctacgcgagtcacttcacctgttttaggatcgagcggcataacgtttgatacatgaattggcgcctcttgattagaaataccgccttgagggtttgcttgagttggtttagagtgcttcttcaccatgtttacgccctcaactagaacgcggtcctttttagggaaagcagcaaggatcgtaccttgtttgcctttatctttaccagagataaccattactttatcgccttttttcacatgcatcctgatcgcacctccttgagtaaggcatttatttcattagataacttctggagccagagaaacaattttcatgaagttgttttcacgtaattcacgggcaaccggtccgaagatacgagttccacgcgggctcttgtcgtcacggatgataacacatgcattctcatcgaagctgatgtatgatccgtcagttctgcgtgctccgctttttgtgcgaacgataacagctcttacgacttcaccttttttgacaacgcctcctggtgttgcttgtttaaccgtgcaaacaattacatcaccaatgttagccgttttacgtccagaaccgccaagaactttaatagtaagtacctcacgcgcaccggagttgtcagcaacttttaaacgagtctcttgttgaatcattatttgttacctcccttcggaaaaagaattccgaactttattagataataacagcttcttcgacaacttctactagacgaaaacgcttagttgcagataatggacgagtttccatgatctttacgatgtctccgattttagcttggttattttcatcatgtgctttgaatttctttgagtattttacgcgtttaccgtaaataggatcctttttgtatgtttcaacaacaacagtgatggttttatccattttgtcagaaacaacacggccttggtaaactttgcgttggttacgttcgctcatgctcacgacctcccctcagtgattatttgttggcagcaatttctctttcacgaatcacagttttcatgcgcgcgatagctttgcgcacttcacgaatgcgagcagtattttcaagttgtcctgtcgctaattgaaagcgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaagacgaagagcttcacgagctacctcttcagacacaccagaaatttcaaataaaactttgcccggttttacaacagctacccagccttcaggagcccctttaccggaacccatccgtacctcaagcggtttagcagtgtaaggttttgaagggaaaattttaatccaaactttaccgccacgtttcatgtaacgagtcatcgcaatacgtgcagcttcgatttggcggtttgtgatccaagaagcttcaagagcctggataccgtactcaccaaaatgtacttcagtaccgcctttagcgcgaccgcgcatttttccgcgatgctctctgcgatatttaacgcgttttggtaataacatattattttcctccttcctcagttttcttcttagtaggaagaacctctccacgatagatccagacttttacaccaagcttaccgtaagttgtgtcagcttcagatgttgcatagtcgatgtcagcacgtaaagtgtgcaatggaacagttccttcactgtagtattcagaacgagcaatgtcagctccgccaagacggccggaaaccattgttttcacaccttgtgctccagcacgcatagtgcgttggatttgttgtttctgcgcacggcggaaagaaatacggttttctagttgacgagcgatgttgtcagctacaagctgagcatcaagatctgctcttttgatttcaagaatgttaatgtgtacacgcttgccagtaaggctgttaagggctttacgaagtgcttcaacttcagatccgcctttaccgattaccataccaggcttagcagtgtggatcgtaatgttaacgcggtttgctgcgcgctcgatttctactttagaaacagaagcgtcagaaaggcgtttgctaatgaattcacgaatttttaaatcttcgtgcaggaagtcagcgtaatctttaccagcgtaccacttagattcccaatcacgaatgactccgatacgaagaccgactggatttaccttttgacccactacttatccctccttcttttctgatacaacgattgtaatgtggctcgtacgtttgttgatttggctcgcacgtcccatagcacgcgggcggaatctttttaacgttgggccttcgtcaacaaatgcctgagaaataaccagattgttagcgtccatctcgtagttgtgctcagcatttgcgatagcagattttaaaactttttcgatgatcggagaagcagctctcggagttaagttcaggatagatactgcttcgcctacttgcttacctcgaatcaggtccattactagacgtgctttacgaggagcaatacggactgttcttgcaacagctttagcttgcatttaaaagcctcctctcttagcgtcttgtttttttatcgtcactggcgtggcctttgtaagtacgagtcggtgcgaattcgcccaacttgtggcctaccatgtcttcagaaatgaatacaggcacgtgtttacgtccgtcatatactgcgatagtgtgaccgataaattgtgggaaaatagttgaacggcgagaccaagtttttacaacttgtttcttgtccgtttcatttaatttctcgatttttgtcatcaagtgtccatcgacaaatggtccttttttcaagctgcgagccattttggaacctcccttcgtgattgcactacggtccgaaatgaaccgtagacaaccccattatttatttttacgacgacgtacgataaatttatcagatttgttctttttcttacgtgtcttgaatccaagagtcggtttgccccaaggagacattggtgatttacgtccgattggcgcgcggccttcaccaccaccgtgcgggtgatcgttagggttcattacagaaccgcggactgtagggcggatgcctttccagcgagagcgtcctgctttaccaacgttgataagttcgtgctgctcgttacctacttgaccgatagaagcgcggcaagcagaaaggatcatgcgaacttcaccagagttaagacgtacaagaacgtatttgccttctttaccaagaacctgagcagatgtaccagctgaacgtacaagctgtccgcctttaccaggttttaattcaatgttatgcacaactgtaccaacagggatgttgataagcggaagtgcgttacctactttgatgtcagcttcagggccggacatgatttcagtacctacttgaattccttttggtgcaagaatgtaacgtttttctccgtctacatagttgattagtgcaatgttagctgaacggtttggatcgtactcaactgtagcaacgcgtccaggtataccatctttatcgcgtttgaagtcgataacacggtattggcgtttgtgtccgccaccttggtgacgtacagtcaatttaccttggttgttacgtccgccttttttgtgaaggggcgcaagcaaggatttttccggctggtcagtcgtgatttcagcaaaatctgaagttgtcatgccacgacgtccgttagaggtcggtttatactttttaatcgccattttgaatttccctccttctttttacagataattaagcttcaaaaatttcgatttctttgctgtctgcagtaagttttacgatcgcttttctgcgacggctagtcataccagtgtagcggccgacacgttttgatttccctttgtagttcatgatgttgactttgtcaactttcactccaaagatactttcaactgcatctttcacttctgttttattagctcttacatcaacttcaaaagtatatttcttttcagtcattaaatcagcagaacgttcagtaatgacggggcgcttaagaacatcacgaggatctttcattatgcaagcacctcctctactttttcaaccgcagcttttgtaatcagaagcttctcgtggttgacaacgtctaacacgttgattccgttagcttgaacaactgtaactccagggatgttgcgtgcagaaagagatactgcttcgtttgcatccgcagttacgattaaagcttttttctcaacagataatcctttaaggatagctgccatttcttttgttttaaccgtatcaagagtaagatcttcaagaacaataatgttgttgtcgttcactttagaagacaatactgatttgattgccaagcggcgaacttttttaggtaatttgtaagaatagctgcgtggtgttgggccgaatacgacaccacctccgcgccattgcggtgaacggattgaaccttgacgggcacgacctgtacctttttgacgccatggtttgcgacctccgccgcgtacttcagaacgattttttactttgtgagatccttgacgtaaggaagctctttgcataagaatagcgtcgaatactacgctctcatttggctcaattccaaatacagacgcgtttaattcgatatcaccagcagtagaaccgttttggttgtataatgctacttttggcatgatcaatttcctcctttcctaagagacttatttagatttaacagcacttttaacagtgattaaagtttttctcgcaccaggtacgttacctttaatcaaaagaagattgcgctcagcatctacttttacgatttcaaggttttggacagtgatttgatctccgcccatgcgtccaggtaatagtttacctttgaatacacggttaggatctacaggtcccattgaaccaggacgacggtggtagcgtgaaccgtgagacataggtccgcgagattgtccgtggcgcttgattgcaccttggaaacctttacctttagatactcctgttacatctacgatttctcctgcagagaaaatttcaaccttgacttcctgaccaatttcatacgcatccatatccacgccgcgtaattctttaacgaagcgcttaggagcagtttccgcttttgcaacgtgtcctttttccggtttgtttgaaagcttttcacgcttatcgtcaaaaccaagctggatcgcttcatagccatcattttcagctgttttcttttgaagaacaacgtttggagctgcttcaataacagttaccgggataagatcaccgttctctgcgaatacttgcgtcataccaatttttcttcctaagattcctttggtcattcgtcacacctcctattaagatcattctatattttagaattaaagtttgatttcgatatcgacaccagatggtaagtctaatcgcatgagagcatcaacagtttgtggtgttgggttcacaatgtcgattaaacgtttatgtgtacgcatttcaaattgctcacgagaatctttgtatttgtgcaccgcacgaaggattgtgtaaactgatttttcagttggcaacggaatcggaccagatacgctggcaccagaacgttttgccgtttcaacaatcttctctgcagattgatcaaggattctatgatcatatgcttttaaacgaatacgaattttttgttttgccattattttccctccttttcgcctacatcacgttagacagttctccgtgagaaaaacctgatcaccttgccatggcaaagcggccgggtgtgtcagcaacctctcacttcatcgcagtcaaagaccaacatacactattatacagaaaatagacgcatgttgcaaggtttatttaaagaaccttgtggttttcacactttgattattatacaggtgataccatgattaatcaaggatatgcctgttttctttcagagatggaacgatgcgaaccggctgacaacttcggcaaagcgatccggttcctccaagtgaggcgaatgggctgagttctcaaaccaatgccattctttatacggcgcatcaaccttctgataatattcataagacgtcgtccccgggaccgtcaaatcgtatctccctgacataaaacagcacggtattataatagaagaaactgattctccggcatcaaagaaaatgagatcctcccacaggtgtttcaggctgaacatttgcccccgcgcggctaagaagctccccctcacaccgtacggttcaccaaacagcattcgcccccctgctttaagagcaccgatcggatgatgggtaaagccccctcccctcatctcgatacaaagcagaaataacgatcgctgcagctgtttctcccatggaggcgctccgataaagcgcagcgtcttttccagcaggaaatgtttgcgttgcctgctccattccatcatcagccggtaagcttccatttcttccttttgaatattaaccacctgactgataccgatatacccataatacaaatcaggtctctcttgaagaacatgaagcgccagaactgacccccacgaatagccggcgatatatattttttgcctgctgaattgcttgcataagcgttcagtcaaatgaatggtatcggctgtcagctgatccaaggtcatagatgagcccggaatttcctttgaataagagagacccgcccctctctgatcccagttcacaacggtgaaatgcttttccagcttattctggtattttctcgcatagccgatttgaggagtgccgggaccgccgtgcaaaaacaaaagcagcggattactcctgtcatcaccattaatcataatggtttgttcactgccattaatcagcaattgctgaagcattgaaatacgattggttttcttgaagttatcgttcatcggtctgctcctaaaatttgtatacgttctattatacatggaatcagcggggaaacaaaaaaacgaggccccataagggaccccgcattaatgaacgagtcgattactcagtgattgtagaaacaacgcctgaaccaactgtacgtccgccttcacgaatagagaaacgagttccttcttcgatagcgattgtagagataagttcaacgatcatttcagtgttatctccaggcataaccatttctacgccttctggaagattgatgataccagttacgtcagttgtacggaagtagaactgaggacggtagttagagaagaatggagtatgacgtccaccctcttctttagaaagaacgtaaacttcagctttgaatttgctgtgtggagtgattgtacctggtttagcaagtacttgtccacgttggatgtcttcacgagctacaccgcgaagaagcgcaccgatgttgtctccagcttcagcatagtcaagaagcttacggaacatttcaacacctgtaacagttgttttgctgttttcttcttgaagaccgatgatttcaacttcgtcaccgactttaacttgtccgcgttctacacggccagtagcaactgtaccacgaccagtgattgagaatacgtcctcaactggcatcatgaatggtttgtcagtgtcgcgttctggagttgggatgtactcgtcaactgcagccataagttcaagaattttttcttcgtactcagcgtcaccttcaagagctttaagagcagaacctttaacaactggtacatcatcaccagggaagtcgtattcgctaagaagatcgcgaacttccatttcaacaagctcaagaagctcttcgtcgtctaccatgtcgcatttgttaaggaatactacgatgtatggtacaccaacgtttttagaaagaaggatgtgctcacgagtttgtggcattgggccatcagcagcagatactacaaggatagctccgtccatttgcgcagcaccagtgatcatgtttttaacatagtcagcgtgtcctgggcagtcaacgtgtgcatagtgacgagtgtcagtttcgtactcaacgtgtgcagtagagattgtgataccgcgctcacgttcttctggagcaccatcaatttgatcgtacgccatagctgtacctttaccagatttcttatgaagtactgttgagatagcagcagttaatgttgttttaccatggtcaacgtgtccaattgtaccgatattggcatgtgatttggaacggtcgaatttttctttagccattctaaaatcctccttaagagcttttaattagtaatgtatagagtgatagaaagtgaaagcaagctttcacttcctcatcttacaatagtagttatacttgagttaagtggcaaaatcaattattcgcctttattttttttgataatttcttcagcgatgctcttcggcacttcttcgtagtgatccatgaacattgtgaacgtaccgcgtccttgcgtgttagaacgaagggcagtagcgtaaccgaacatttcagcaagaggtaccatcgcacgcacaacttgagcgttaccgcgagcttccataccttctacgcgtccgcgacgagaagtaacatcccccatgatgtctcccatgtattcttcaggaataacaacttcaactttcatgattggttcaagaagaactgggttacatttgctgactgcatttttcaatgccatagaagcagcgactttaaacgccatttcgtttgagtcaacatcatggtaagatccatcaaaaagtttcgccttgatgtcgattagcgggaatccggctaggacaccattttcaagagagtcttcaagacctgcttgtacggctgggatgtattcacgaggaacaacacccccgacgattgcgttttcgaattcaaagccagcgccttcttcgttcggttcaaattcgatccaaacgtgaccgaactgaccgcgtccgcctgattgacgtacgaatttaccttcaacttttgcaccggtacggaatgtctcacggtacgcaacttgaggagcaccaacgttagcttcaactttgaactcacgcttcatacgatcaacaatgatatcaaggtgaagctcacccataccagagatgattgtttgacccgtttcagggtttgtttgtgtacggaatgtaggatcttcttcagcaagtttcgctaaagcgatacccattttatcttggtcagcttttgatttaggctcaatcgctacgtcgataacaggctctgggaattccattgattcaaggattacaagatccttctcatcacatagagtatctccagtagaagtatcttttagacctacagcagctgcgatgtctccagcgtaaacagtagagatctcttcacggctgttagcgtgcatttgaaggatacgtcctacgcgctcacgcttgccttttgtagagttctttacatatgaaccggaatcaagtgtaccggaatatacgcggaagaatgtcagcttaccgacataagggtcagtcataactttaaatgcaagtgcagagaacggctcttcatcagaagaatgacgaacgatctcttcatctgtgtcaggacgtacacctttgattgcagcaacatcagttggcgcaggaaggtagtcaagaacagcatcaagtacaagctgaacacctttgtttttgaaagcagatccaacaagtacagggtagaattcaacattcagtgtacctttacggatagcagctttcagttcagggatagtgatttcttcaccttcaaggtacttttccataagctcttcatcaagctcagctacagcttcaatcaggctgctgcgaagctcttcagcttgctctttgtactcttcagggatttctttcgcatctgaacgagttccaaggtcatcttcgtagaaatacgcaacgttttctactaagtcgatgataccttcgaagttgtcttcagcgccgatcggcaattgaattgcgtgagcgttagcttgaagacggtctcttaaagtgcctacagagtaaaggaagtctgcgccgattttgtccattttgttgacaaatacaacgcgcggcactccgtaagttgttgcttggcgccatactgtttctgtctgaggctcaacacctgattgagcatcaagtacggcaaccgcaccatcaagtacacggagtgaacgttcaacttcaactgtgaagtctacgtgtcccggtgtatcgatgatgtttacacggtaacctttccactgtgcagtcgttgctgcagaagtgattgtgataccgcgttcttgttcctgctccatccagtccatttgcgaagcaccttcgtgagtttcgccaattttgtggatacggcctgtgtagaacaagatccgttctgtagtagtcgttttaccggcatcgatgtgagccatgatcccgatattacgagttttttctaaggagaactctcttgccattgggtaatttctccttccttattagggaattattattttgattatatgaatcctaccagcggtagtgagcaaatgctttgttcgcttctgccatcttgtgagtgtcttcacgtttcttaacggcagcaccagtgttgttagctgcatcaagaatttcgttagccaggcgctcttccattgttttttctccgcgaagacgcgcatagttaaccaaccagcgaagaccaagagttgtacggcgttcaggacgaacttctacaggcacttggtagttagctccacctacacggcgtgcttttacttcaagtacaggcatgatgtttttcaatgcttgttcgaaaacctccattgcatcattgccagtgcgttctttaatgatatcgaatgacttgtataggattgtttgagatttaccttttttaccgtcgatcatcattttgttgatcaggcgggataccagcttagagttgtaaagcggatcaggtaaaacatctctttttgctacaggacctttacgtggcatctgaatatcctcccttcatagttttaatgatttatttgattactttgctttaggacgtttcgtaccgtatttagaacggccttgcgcacggttttcaactccggcagtatcaagcgcgccacgaacgatgtggtagcgtacccccggtaagtcttttacacgtccgccgcggatcagtacaacgctgtgctcttgcaggttgtgaccgataccaggaatgtaggcagtaacctcgattccgttagtcaaacgaacacgagcatatttacgaagtgctgagttcggttttttcggtgtcattgtacccacacgagtacataccccgcgtttttgtggagaagatacgttagtgtgctcttttttaaagctgttgtatcctttgtttagtgcaggtgacttagagttttcaactttgctcacgcgtcccttgcgaattagctgattaattgtaggcatgttgtgttcctcccttcattacgttttataacccacatacccaggtggttcatcattaggcaaaaaacaatgtctttacacaagattgatatcttatataaaaacaaaaagtacgctataacataatggcaacagctgctgctcccacttcaattccgcaggctttgccgagctttttcatggaatccaccatacagacagcggtattttggttctttgcaagctggataacgccagctgtaagaactgaatccgcgtcttttgccacgacgacttccttcactgaacctcgttttagagctttcactgtttgcttcgtaccaataataattgatttggcctgtgatactttatcataagacataaacatatcctccaaagtaacaggttttatttcgagcaccttggttatattatcactctgcgggacggatgtcaacaacgtatgacattttttagtgcagtccaccgccagaataattgtaatactgaggaaaagctgtcgaaacagcctttcctgcagcagtctctgttattcagccggaaccatatcttccgaaggctgaacgtttgaaacaggttttacttttctgtaattcatcataccggtaccggccggaaccagtttaccgatgataacattctctttcaggccgagaagttcatcgcgcttgcctttaatcgcagcatctgtaagaacgcgtgttgtttcttggaatgatgcggcagacaagaatgaatccgtctcgagtgaagcttttgtgataccgagaaggacaggacggcctgtagcaggtcgattgccttcaagcagcacttttttgttcgcttctgtgaattggtgaatatctagcaatgtgccagggagaacatcagtatctccggcatcgatcacacggactttgcgaagcatctggcgaaccattacttctacgtgtttatcgccgatttcaaccccctgcatacggtaaaccttctgaacctcatgcagaagatattcctgaaccgttgtcaggtcagtgactttaagaagttctttcggatcgatagaaccttctgtcagcacttgaccgcgggtaatctgatcaccctcagccactttcaggcgtgagttgtaaggtgccgtgtatgaacgtgtctcaacagcgccctgaacaacaatctcctgctgtttgtcgcggacttcattgatttcggcaattgtaccgtcaatctcagaaatcgtcgcttgacctttcggattacgcgcttcgaaaagctcttggatacgcggaagaccttgtgtgatatcgtctccggcaaccccgcctgtgtggaacgtacgcattgttaactgtgttccaggctcaccgatagattgagcggcgataatacctactgcttcgccgacttcaacatcagttccggttgcaaggttacgtccgtagcatcgtttacatacaccatgaggagtgttacatgtgaacgcagaacggatccacacttcttcgattccggcttcaacgatttccagcgctttatcttcatcgatcaattcattttcgttaatgagtacagcacccgtttcaggatgtttgatctgttttctggcgaaacgtccgatcagacgctcttccagacgctcgatgatttccgtgccttctttgagcggttttgcaagaataccgcggtctgttccgcaatctgtttcacgaatgataacatcctgcgcaacatcaacaagacggcgtgtaaggtaacctgagtcagctgttttcagggcggtatcggcaagacctttacgcgcaccgtgagtggagataaagtactccaatactgtcagaccttcacggaaactcgatttaatcggcaattcaatgattcgtccagccgggttggccatcagaccgcgcatacccgcaagctgtgtaaagttagatgcgttaccacgggctcctgagtcactcatcatgtagatcgggttgacttcgtctaatgatttcatcagtttgccttggataacatctttcgctgaactccaaattgaaatgactctttcataacgttcttcttcggtgattaaaccgcgtctgaactgtttcaggacattatcaactttgctttgtgcttcttcaaggatttcctgtttgtcatcgagaacgacgatatcagaaacccctactgtgatgccggctttcgttgaatatctgaaaccgaggtttttcatgcggtcaagcattttagacgtttccgtgatatggaatcgtttaaagatttccgcgatgattttaccgagaatgccttttttaaacggtgcgttgatcggctgctcagcaatcacagcttttacgtcagcacctttatctaagaagaaacggtcaggtgtcttctcttcaatgttgctcttcgttggttcattcatgtaagggaatgattccggaagaatttcattgaagacgagcttaccgacagttgtaattaacaattttgaacgctgttcttcagtaaatgtcacattcttaagggagttcgctgcaacagcaactctcgtatgaaggtgaacataaccgttttgataagcaagaagcgcttcgtccgtatttttgaaaaccataccctcgccgactgctccggcgcgctcaagcgtcaggtagtagtttcctaataccatatcctgagacggcgtaacaaccggtttaccatctttagggttcaagatgttttgggccgcaagcatcagaatgcgcgcctcagcttgagcctcagctgataaaggtacgtgaaccgccatttggtcaccgtcaaagtcagcgttataagctgtacatactaacgggtgaagacggatggcgcgtccttcaacaagcgtcggttcgaaagcctggatacctaatctgtgaagagtaggggcacggttcagtaagaccggatgctccttaatgacagattcaagtacatcccatacttcaggctgcacgcgttcgattttgcgttttgcgctcttgatattgtgagcaaggcctttttcaacaagctctttcatgacgaaaggcttgaagagctcaagcgccatttccttcggcaaaccgcactgatacattttcagatgcggacctacgacgataacggaacggcctgagtagtctacacgtttaccgagaaggttctgacggaaacgcccttgtttccctttcagcatgtgagaaagagatttaagcggacggttacccggtccggtaaccggacggccgcggcgtccgttgtcaatcagagcatcgactgcttcctgaagcatacgtttttcgttctgaacgatgatgcttggcgcgccgaggtctaacagacgttttaaacggttattacggttgatgacacgacggtaaaggtcgttcagatcagacgttgcgaaacgtccgccgtcaagctgaaccatcggtcttaattcaggcggaataaccggaagcacgtcgaggatcatccaagacggcttgtttcctgaattacggaaggcttcaagcacttcaaggcgtttgatcgcacgtgtacggcgctgtccttgagaagtcttcagctcttcttttaacatatcaacttctttgacaaggtcgatgtcctgcagaagtttattaatggcttccgcacccatagaggcttggaatttgtttccgtacttatccagatacgcacggtattccttttcagataaaagctgtttcttttcgagcggtgtattggccgggtcagttacgacgtaagaagcaaagtaaataacttcttccagcgcacgcggtgacatatccaatacaagacccatacggctcggaatacctttgaaataccaaatgtgagaaaccggggcagccagttcaatatgccccattctctcacgacggactttagcccgcgttacttcaactccgcaacggtcacaaactacgcctttataacgaacccgcttgtacttgccgcaatgacattcccagtccttagtcggtccgaaaatgcgttcgcagaacaggccgtccttttcaggtttcaacgtacgatagtttatcgtttcaggctttttcacttcaccaaaagaccatgaacggattttatccggtgaagcaagaccgatgttcatatactcaaaattgttcacatctagcaaggggcctacctccctttttatcttcggattaaccgatgtcacttgcctttatcaatcagagactattctttcgttactgcgtcacgttcaacgtctggagatgctgtttcttccggcgcttcatcacctgataatgcaaggccgtcagcttgtttcgcatcttcctcgtcttctagatctctcatttctatttcttcttcatcgcctgaaaggatttttacgtccatacctaagctttgaagctctttgatcaatactttgaatgattccggaacaccaggctctggaacattgtcgcctttgacgatggcttcatatgttttcacacgtccgaccacgtcatcggacttcacagtcaggatttcttgaagcgtgtaagctgcgccgtaagcttcaagcgcccaaacctccatctcaccgaaacgctgtccgccgaattgggctttaccgccgagaggctgctgcgtaacaagtgagtaaggacctgtagaacgggcatgaagtttatcatcaaccatgtgcgccagtttgatcatgtacatgattccgacagatacacggttgtcaaacggttctcccgtacggccgtcataaagaactgttttagcgtctcttgacatgcctgcttcttcaagtgtttcccacacatcttcttcacgcgcgccgtcaaatacaggtgacgcgatgtgaatgccgaggtagcgggcagccatacccatgtgaagttctaatacctgaccgatattcatacgtgatggtacacccagcgggttaagcatgatatcgatcggcgtgccgtcaggaaggtaaggcatatcttcttcaggaagaatcttcgagataacccctttgtttccgtgacgtccggccattttatcaccttcagaaatcttacgtttctgaacgatatatacgcgtacaagctggttcactcccggaggaagttcgtcgccgtcttcacggttgaagacttttacgtcgtggataattccgccgccgccgtgaggtacacggagagaagtatcacggacttcacgcgctttttctccaaagatcgcatgcagaaggcgttcttcagccgtaagctcagttacacctttaggcgttacttttcctacgagaaggtctccgtcgttgacttccgcaccgatacggataattccgcggtcatcaagattgcgaagcgcgtcttcccctacgtttggaatatcgcgggtgatctcttcaggcccaagctttgtatcacgtgcttctgattcatattcttcaatgtgaatagatgtgtatacatcatctttcacaaggcgttcactcataatgatggcatcctcatagttgtaaccatcccatgtcatgaagccgaccattacgttgcggccgagagcaagttcaccaagctccattgaaggtccgtcagcaaggatttctcctttgactacttcatcgccgacactgacgatcggacgctggttgtagcacgtaccttggttggagcggacaaatttcagcaagctgtacttatccaggttgccttttactttttggccgtcaatttcttcatagcggcgcacccatacgtttttcgcttccacccgttcaacgataccagggtgtttacaaataacggctgcaccggagtctttaccggatacgtattccatacccgttccgacgatcggagcttccggctgcatcaaaggcacagcctgacgctgcatgttcgctcccatgagggcacggttcgagtcatcgttttccaagaacggaatacatgctgtcgcagcagatacaacctgtttaggagatacgtccatgtaatccacgcggttgcgggctacaacggtgttttcccctctgaaacgcgctacgatgctgtcatccaagaaagaaccgtcatcgctcagcttagcattcgcttgggctacgacatagttatcctcttcatcagcagtcaggtagtcgattctaggcgttacttttcctgtttcaggatcaacgcggcggtatggcgtctcaatgaaaccaaagcggtttactttcgcaaatgatgacaatgagttgatcaaaccgatgttcgggccctcaggcgtttcaatcggacacatacggccatagtgagagtagtgaacgtcacgtacttccatacctgcgcgctcacgtgtcaaaccgcccggtccgagagctgacagacggcgtttgtgtgtcaattcagcaagcgggttcgtctgatccatgaattgagaaagctgtgagcttccgaagaactctttaatagacgcaataacaggtctgatgttaatcagctgctgcggcgtaattgtattcgtgtcttgaatagacattctttcacgtacgacacgttccatccggcttaaaccgatacggaattggttttgcaggagctcacctacagaacgcagacggcggtttccgagatggtcgatatcatcagtgtcgcccactccgtgcaggaggttgaagaagtagctgatagaagaaataatatcagcaggcgtaatgtttttaatcgcctcttcgatgtaagcattgccgatcacattgatcgtctgctctccttctgcatcggtaggagcatagattttaatggattgaagcatcacttcatcctcgacaacgccgccgttaggataaagttttctgaagccgattccattttctaagtatggcagtactttatcaagtgttcttctgtcaagaatctgccctttttcagcgagaatttcaccggtttccggatccaccagtgtttctgcaaggcgctggttaaacaggcggttcttgatatgaagctttttattaattttatagcgtcctacattcgcaaggtcgtatcgcttcggatcgaagaaacgggaatccagcaagctttttgcgttttctactgtaggcggctctccgggacgaaggcgctcatagatttcaagaagcgctttgtcactgttttcagtgttgtccttatccagtgtattgcggagatattcattctcaccaatgagatcgagaatctcttggtcggaaccgaagccgagagcacgcaaaagaaccgtaaccggcaacttacgtgtgcgatcaatgcggacatacacaacatctttcgcatcagtttcgtattctaaccatgcgccacggtttggaatgacagtcgcggtaaaaccttttttaccgttcttgtctactttaccactgaaatatacacttggagaccgaacaagctgagatacgataacacgttctgcaccgttgatgataaaagtaccggtatctgtcataatagggaaatcacccatgaagacatcctggtcttttacctctccagtttctttgttaattaaacgaaccttcactctcagcggagctgagtaagtcacatcacgttcttttgactcttcaacgggatacttaggatctcctaaactgtagtcaatgaactctagagagaggttaccagtgaaatcctcaattggtgatatgtcttgaaacatctctctaagaccctcatcaagaaaccactgataagaagaggtttgaatttcaatgagatttggtaattctaacacttcgctaatgcgagcatagcttctgcgctggcggtgtcgtccatactgaactagttgacctgtcaactgattcacccctcaaatcatgcgtattatatgtgtaataagcatctcttacgataaagaaatacttttacaagacaaaagaaaaaagggtttctaattaagaaaaccacatccaaaaacaaataccgattttattagcatttccatgtttgtataatttatacatgcactatgattatttcagcatatcatgcaaaatatatacattggcattttacaatattaacatagctgaaaaatcaagtcaaactttttttgcttttatgatataatagcctttctttttttgaatcacagaaacttcgtcaaaaagctccttcagtttttcaatggcagaaggcccgccctgttttttctgtataacgatccacaattcacctgaagcccttaaatgctcagcgcttttttcaaaaatggcatggacaactttttttccggcgcggattggggggtttgtaataatagaagcaaatgtttgagcagaatcaatatttgaaaataaatcactctgataaatccgaacgttttttattccgtttttttctgcattttcatttgacagctctacggctctttcattcacgtcaatcatgtgcacggtccggtccgtaaattcaccggcgagtgacagaccgatcgggccgtaaccgcagcctgcatccaggaagtcaccatcgatctccggctcttcaaacgcttcaattaagacacgcgaaccgaaatcaacttcctttttcgagaaaacgccgctgtcacttgtgaatgtataagatctgttccgcagtgtaaatgaccatgtctgtttatcgcttttaactgaaggtttttctgaataatagtgatcactcattattagaacctccttttataatggcacttaaagaaaagcaaagaaaaagcccgcctcataaaagcgagcttcccctacaggcaagtgaagattacttaacttctacagaagcgccaacttcttcaagtttagctttaagctcttcagcttcttctttcgcaataccttctttaagtggttttggagtgttgtcaacaagttctttagcttctttcaagccaagaccagtgatttcacgaacaactttgataactttgattttctgagaacctgcaccagcaaggataaggtcgaattcgctttgctcttcagcagcgccgccagcagcagctccgccagctacagctacaggagcagcagcagttacgccaaattcttcttcgattgcttttactaggtcgttcaattcaagtacagttgcttctttaacggaagcaatgatttcttcgatatttaaagccatttgaaattcctccatttgttttattttagggtaaaatcagattaagcgccttgttcttccttttggtctgcaactgctttagctgcaagtgcaaggttgcgaactggagcttgaagtacgctaagcaacatagaaagtaagccatcgcgtgaaggaagttcagcaagagctttcacttcttcaacagaagatacttttccttcgataacgcccgctttgatttccagagcttcgtgatttttcgcgaactcgttaagaacttttgccggagcgataacatcttcagtactgaatgcgatcgcattcggtccagttaagacatcattcaaaccatcaagttcagcttgttcaaccgcacggcgagtcattgtgtttttgtacactttgaactctacgttagcttcgcgaagctgtttacggagttcagttacttcagaaacgttaagtccgcggtagtcaacgatgatcgttgatttgctttctttcagtttagaagcaatctcttcaacaacaactttttttgtatcaattgcgctgctcatggttacacctcctgtagattttgtgtaacacttataccgctaggtgatcacgactgtgacgacgatttcatataaaaagcctccatgtggacatggaggctgtatatacaagcatacgtaacgtaatagctgtgatatatatacacctcggcaggatattaagccttaacggcccctgctgtctacggtataaatgacatattatattttacaacattttgaatcatatcagaatgctgatctaaagtcaaatattattttacgttgaaagtagaagcgtctactttgacaccagggcccatagtagaagtaacggcaacgtttttcacgtaaacacctttagccgcagccggttttgctttcaggattgtatcatacattgttgtgaagttctcaacaagtttttcatcctcgaaagaaacttttccgatcggaacatggatgttaccagctttgtcaacgcggtattctactttaccagctttgatttcgccgattgctttttccacttcgaatgtaacagttcctgttttagggtttggcataagaccttttggtccaagcacacgaccgattttaccgacttcacccatcatgtcaggagtcgcaacgattacatcgaattcgaaccagccttgctggattttcgcgatgtaatcagaatcgccaacgtagtctgcaccggcagcttcagcttcttttgctttttcgcctttagcgaatacaagcacgcgctgagttttaccagttccgttaggaagtacaactgcaccgcggatttgctgatcgtttttacgagggtcaacccctaaacgaaaagcaacttcaactgtagcgtcgaatttagctgtgtttgtttttttagtaagcgccactgcttcagcgacatcataagctttcgcacggtctacaagcttcgcagcttcaacgtactttttaccttttttagccattttaaaatttcctccttatgtggttatagcggaataacctcccacgaataagggttgcgaacttgtgaaaactcgcaacccgacaagaaacaaattaatcctcgataacgatacccatactgcgggcagtaccttcaaccatgcgcattgccgcttcaacgtctgctgcgtttaagtcaggcattttcgtttcagcgatttcgcgaaccttatcgcgcttaacggttgccactttattacggtttggttcaccagaaccagactcaattccagctgcttttttaagcaatactgcagcaggcggagtttttgtaataaatgtaaatgaacggtcttcgtaaaccgaaatttcaacaggaatgattaaaccagcttggtcagctgtacgagcgttaaactccttacagaatcccatgatatttacaccggcttgacctagtgcaggtccaactggcggcgctgggttagcttttccagcaggaatttgcaattttacaacttttactacttttttagccacgagacacacctccttaagtccgtgatgtggtaatagggtaaaccctcccactcaaggtttcattctttatatgaatgacgaaatatcaagctagctgccttggattagtccaagacgtacctttgctatattatcattaatatatagcaatttcaagttttttcacattacaatttgtcgatctgggtaaattccagttcaaccggcgtttcacggccgaacatgttaacgaatactttcactttgctcttatcataatcaatctcttcaattgatcctgtaaagttggcgaaaggtccgtctatgactttgactgtctcattcaattcaaaatcaatgtcggttttccgctcatccatgcccatgcgttttaagatggtttccgcttcgccaggaagaagcggagtcggctttgagcctgaaccggctgatccgacgaatccggtaacgcccggcgtgttgcggaccacataccaggaatcatcagtcatgacgatttcaacaagcacataacccgggaacactttctttttgactacttttttcttgccgttcttaatatcagtctcttcttcttcagggacgacaacgcggaaaattttatcctgcattcccattgattccacacgtttttcaaggtttgcttttactttgttttcataaccggaatacgtatgaacaacataccaattcttttccattctatcaggactctgcagtccttccctccccgcatttaaaaatgaagtgtaaaacaaaaaataggctcagggcctatgaatccttttttcaacaacacaataaaaaacccgctgaacgggttttggcaaacgatattatgatctattatagcacgtattgctgatcattattcaactattaaacgaattaattgagaaattcctgtatcaaggagggcaaaaaagataacaaaaaagataaccgttgaaatcaccgtgatcgtatagcgcgttaactctttgcctttaggccagctaacctttttcatttctttcccaacatctttaaagaaactcatcatgcgcatgtaaaagacctccacaatttaaaaagcgaacactattttgtttctaaatgagctgtatgtgaattgcaagtgctgcagtacttcttaacttctaaccgctcagccgctgatgcagagcttttcattgtcgtataattacgatttccgcatgttttgcatgccagcgtaatcttttttctcatgtcgttacaccttttcctaaacattcatttatcttaataaaatagcacagtcagaaaaattctgtcaatatgacacagaaacctgctacaggctgatctctcttatttctaaatacttttcaagcttgcgcttcacgcgctgcagggcattatcgattgattttacgtgtcggtttaagtcatctgaaatctcttggtaacttcttccgtccaagtacaaaacaagcacctttctctccagatcgctcagcagttctcccattttcatttcgatatcatcaaattcttcctgattaataatcatctcttcaggatttaacgttttagcgcctgaaatgacatcaagcagtgttctgtcagattcttcatcaaaaataggtttgtctaaagaaacataggaatttaaaggaatgtgtttctgacgggtagctgtctttattgcggtaataatctggcgggtaatgcataattctgcaaaagctttaaatgaagtaagcttgtcctctctaaagtctcggatagacttatataagcctatcatcccttcctgtacaatatcttctctgtcggcccctattaaaaaataagaccttgctttcgcccgtacaaaattacggtacttcgtaatcaagtaatctaacgcatcactatccccaacatgaaccttttcaatgacctgctcgtcctccaactggcaaaattgcactttgttgaactttcccttgctgttctgtagattcactgcgatccccccggcgcacgtagatagaaatattatacattaatgggcgaaaaagcgtcaacctaatccagaccgcctcggcgccacttttcaaacgttttcaaaacctcttcggacagctcgattttacccggtggtttttcagaagtgatctttgaaacccgcctttgaatccggcgttctatcgtatccacttccctcaggagctcccgggcggatttacggagagccccttgtccgaaaatcgcccactgctccgtataatcggaggttgcgacatgaatctgtgtcgcaatattattcagcgcctgggcaagcttctcgatccgctcatccgccgtttcattctcccgtgtgaaaatcacttcgactctgtgattcgtttgttttttctctatgccttttaccaggtgtgcgtcaaacaccacaatgactctgattcccgtgtaggactgatattccgccatcttctggatcagtacatctctcgcttcttcaaaactgttcgcttttaaatcctttagctgcggccaagctccaatcatgttgtatccgtctactaacaggatgtccatctgtcttcattcccctaaaggattgcgcttccggtagacttcatacatgagaaggccggccgctaccgacgcattcagagaagtgacttttccggccatcggaagcttaatgagaaaatcacatttctctttcacaagccggcccattcctctgccttcgcttccgataacgagcgccaaaggcatcttgccgtccatagagcggtagtcttcccgggcggatgcatccgttccgacgacccaaatcccccgccccttcatttcatcaagtgtccgggcaaggttggtcaccttcacgacgggaatatgttcaatcgcaccggtcgaagcttttgcgaccgtcgaagtcagtccgactgctctgcgtttcggaatcacgatgccgtgtgcaccgacagcgtcagccgttctcatgatggaaccgagattatgagggtcttccagctcgtccagtatgagaaagaaaggctgttcgtttctctcttccgctcttttatataattcgtctaattgtgcatattcatatgccgccacctgggcgacaacaccctgatgctgcccctccaccatctgatcgagttttttcctcggtacaaattgaatggtgacgccgcgctttttagcaagctccataacttgctgcgcctgtccttttactgtgttttccgccatccataacttatacagcttgcgatctgactttaacgtctcaatcaccgcgttttttcctatgacgtaatcatgttgctgactcatttgttttcctccctgacgtcccgacttgtatagcctcagcaatcagctgattcagtctttcttctcttttctcaagaaaaaggtaaccgagtaaagcctcaaaagctgtactatggcggtacgtctgtacatctgtgtttttaggcgtcgtccctgatttcgcgtttctgcctcttctcagcacggcttcctcttcctccgtgaaaaaggattcgtcctgaaggcggaacaatatgtctgcctgtgattttgccgatacaatccggctcgccttcttatgaaggtcattcggtttcgtaaagccctgcttaagcaggtgatgccggacgtatatttcaaaaatggcatcacccatataagcaagcgcaagaccgtttaactgctttgaatctttgatttgttcaaattgaagcatccgcttactctccccgcttccagcgagttccctgggccgtatcttcaagaatgatattcatgcttttcagctgatcgcgaatctggtctgacaaagcaaaatcgcgattgcggcgggcttcatttctcttctcaatcaactcttcaatctgttcgtcgacaagctcttcttcgccgagcgtaagtccgagaacagatccgattctgtcaaacatgctgataaaggctttaatgacgtgatccgccgtattgtcttcctgcatgtagtaattggcgagcttcgccagatcaaaccaaacggaaattgcattcgccgtattaaaatcatcatccattgcttcttcaaacgcagtgcggtgctcttcgattttagcgagccattcctcatcattgtcagtcagattcgtgctgctaatcaaacgatggtttaaattactgtaggccgtcttcaggcggttaaacgcgttttttgttttctcaagcagctcttccgaatagttgatcgggtggcggtaatgaacggacagcatgaaaaatctcaaaagctgcgggtcatgttgcttaatgatatcgtgcaccaaaacaaagttgccgagcgattttgacattttctcattatcgatattgatatatccgttgtgaagccagtattttgcgaatgtcttgcctgttaatgcttcagattgggcgatttcgttttcatggtgcgggaatgtcaggtcctgaccgccggcatgaatatcgatttcgtcacccaaatactttttcaccattgcggagcattcaatatgccagcccgggcggccttttccccaagggctatcccatgaaatttctccgtccttagcagctttccaaagagcaaagtccagcgcatcctctttcttctcgccgacacggatacgcgcgcctgatctgagttcatcaattgattgctgagatagcttgccgtacccttcgaaggcccttgttttgaaatagacgtcgccttctgattcataagcgtagccttttttaatcagttcgctgacaaattcaataatggcacccatgttttccatgacccgggggtgaagatccgctttccggcatccgagggcgcccacatcttcaaaatacgctttaatgaaccgttcagaaacggtcgggacgtcctcgccgagctcgttggccgccttaatcagtttgtcgtcaacatcggtgaaattcgatacgtattgaacatcgtatcctttatactctaaatagttgcgtacggtatcatacacaatcgccggacgggcgttgccgatatgaatatagttgtatacagtcggtccgcacacgtacatttttactttgccttcctcaagaggaacgaatgtttcttttttccgtgtcaatgtattataaagtgtaatggtcatttttggttgatcctttcttttttatcttccagttcagcctgcagttcaaaaatctgctgctccaatgctcttaacctgtcagcaaccggatcgggcaagtcttggtgattgagatcgcgtttgatttttcttccgttctgaatgacgacttttccaggtatgccgacaacggttgaaaagtcgggaacatcacgaagcacaacggaaccggcccctactttagaaccctgcccgaccgtaatagagccgagcaccttcgctccggttgcaattaaagcatcatcttttatggtcggatgccgcttccccttttcttttcccgttcccccgagagtgacaccttggaataccgtcacgttattgccgatttcacatgtttcccctatgacgacccccataccgtggtcaatgaaaaaccttctcccgatggtcgcgccgggatggatttcaattccggtaaagaaacgggcaatctgtgatatcaggcgcgccaggaagaaaaatctccgtttatataaagcatgtgcaatccgatgcgcccatatagcatgtaaaccagaataagttaaaacaacttcgaaatagcttcttgctgccggatcttgatcgaacactgtatctatgtcttcttttagcattttaaaaaacacatgcttccccccattctctccccgctccagtctgtttttccgcctataaaaaaagcgcctctgcatgtaaacatgacagagacgcttttaccgcgcggttccactctgtttgaaaaacaagtcactgttttcccaacttaaaagccggtaacggcggcggccgcctttaaatactgatttccgcagaaatgttcttcaaaggtcttaagggcgcacttctaaaacatgacgcatgaatctctctcagccgatgaagattctttctgtaatggtcattgttttatactcttccctgtcaacaatcgtatatttaaatgcttttcaggcgtctgacggctgtttctctgccgatcagctcaatggcctgcggaagctcaggaccgtgtgtctgaccggtaaccgctacgcgaatcggcatgaacagctttttgcctttatgacctgtttctttctgaacagctttgattgaggctttgatcagctcaggcgtaaattcttcaagctcttcaagcttcgcagcaaatacgctgagcacttcaggcacctgttcctcttccagaacggcttttgcctcttgattatactcgatctcatctttaaagaacaaatcagtcagctcgacaatttcagcgccgtagctcaattgctcatggtaaagagaaattaatttacgaacccattcctgctcctcggcagaaagctcagtgccgacttttcctgctttttgcaggtgcggcagggtcagctcaaccacttgatcaagatccagcgctttgacgtattggttgttgacccatttcagtttatgcatatcaaacagagccggtgacttagacaaacgatttacatcaaaaatttcaatgaattgttctcttgtgaaaagctcttcttcaccgacgggagaccagccgagaagtccgataaagttaaacagcgcttcaggcaggtaacccagctcatcatactgctcaataaactggataattgattcatcacgtttacttaattttttgcggctttcgtttacgataagcgtcatatgtccgaagacaggaacatcccagccgaatgcctggaaaatcatgatctgtttcggtgtatttgaaatgtgatcctcaccgcggagcacgtgcgtcattttcattaagtaatcgtcaatcgcgacggcaaagttatacgtcggtgttccgtcttttttgacgatgacaaagtcgccgatgccgtctgattcaaaagaaatctcgccttttacgatatcgttaaatgcgatgattttcccttccggcacgcggaaacggatgctcggctgtctgccttcggctaaaaactgctcctgctcttcctgagtcaggtttctgtgtttgccggaatagcgcggcatttccccgcgggcgatttgctcttcacgttctttctcaagttcttcttccgtacagaaacatttataagcaagccctttttcaagaagctcttcatagtactttttgtaaatgtcgttacgctcagactggcggtacgggccgtattctccgccgatatccacactttcatcccagtccatgccgagccatttcaaatagttgagctggctttgctctccgccttcaatatttcgctttttgtccgtatcctcaatccggataataaactttccgccttggctgcgggcaaataaatagttaaaaagcgccgttctggcgttaccgatatgcaaatgtccggtcggactcggtgcataacgaacgcgtacttcatttcccatgttcaaatacttcctttcatctcgtctgtagcctctagccgaatatatgtatctattctaccaccaaatagaccgggcatcaaaacaatgatcaggctttttggatcagaacggtcgcctgagcggcaattccttcggctcttccggtaaacccgagcttttctgttgtcgtcgcttttacgtttacttgagagacgtccgcctcaaggccttccgctatccgttttctcatagcatcaatatgcggcgccattttcggcttttgcgcaataatcgtgcagtctatatttccgagtacgtaccctttttcttttacaatgttccagacatgctgaagcagcttaaaagagtccgcatccttgaattccggatcagtatccgggaaatgcttgccgatatctccttcacctgccgctccgagacacgcgtctgcgactgtatgcagcaatacatcagcatctgaatgtccgagcagccccttttcataaggaatttcaattccgccgatgatgagaggacggccttccgttaattgatgcacatcaaatccttgtccgattctaaacattatgattcccactttccgctttcatgattgcttccgcaaatatcaggtcatccggcgttgtcagcttaatattggtatagctgccttcaacgatactcacctgatatccatcaagacgctcgacgaggctggcgtcatccgtccctaagaagcctttgttttccgcttccatatgcgccgtcttcaataaagaaagacgaaaagcctgcggcgtttgaacggcccacaagcttgaacgatcaaaggtctccgcaacccgggagccttccgcccgttttatcgtgtctttcacaggaacagccaggacagccgctcccgcctcctctgctgtttcaacgagcttatcgatatgctgatgtgtgacaaacgggcgcgctccgtcatgaacaaggacgaccgagtccttatcaatcactttcagtccttcgtatacactgtgctgacgctccgcacctccggtaacaagctcaatttccgtctgaatcggaaattgggccagcagctggcgaaaatcttcccgttcactctcgtttatcaccaggattattttctgacagggtgcgtggctttcaaaaacccgcagtgtgtgtataataacaggcgcaccttttaagctgatgaacagcttatttttcccggccttcatccgttttccttgtccggcagccggaataacgacaacatattccatataaactccctcttaaagagctttctcaagcagcttgggcttggcaaaaatcattcgtcccgccgctgtctgcagtacgctggttacgagcacatcaatatgtttccctatataattgcggccttcttccacaacaatcatcgtcccgtcatccaagtaagccacaccttgattatgctctttcccgtccttaatcacctgcacattcatctcttcgcccggaagcacaaccggcttcaccgcgtttgcaaggtcattaatattcagtaccgcaaccttctgaagctcgcatactttatttaaattaaaatcattcgtcacaacgacgccggatgtcagcttcgcaagtttgacaagcttgctgtcaacctcctgaatgtcctcgaagtcgccttcataaatttcaaccgtaatatccagttccttttgaatgcgattcaagatatccagtccgcggcgtcctctgttacgttttaaaacatctgaagaatcagcgatatgctgtaattcctccagcacaaattgaggaatgacaatgacgccttctaaaaagcccgtctgacaaatatctgcaattctcccatcaataataacacttgtatccaagattttcagccttttatcctgttcctcctgctcctcatcagcacttccctttttcttctgcattcttgcagaaatggagaaaagactgatcagttcatcctttttcttaaatccgacttggaagcccaggtaaccgagaaagaaagccagaaagaccggaatgatcgtgctgaatatacggtacggaatattgtccagcggaatcacgtttacaatgagatatgcgatgataagtccaaaaaccaatccgagactcccgaataacagatccggcaccggagctctcagcaaagaatcttcaatccattttacccaattaatcacatattctgtcgtccatatactgatgagaaaaaagataatagcaccaattgcagcagacgtatatgcgtttgttattaaaggtatgtcctgtatatttgacagcacaaacaattcaggtattaaaaagataccgacaacgccgcccacaataatgaagaacgcctgaactattcgttttaacatacctccacctccttttaagtagcattttttcagcagactgggtcagagcctacaaattcagaataaacaaaaactaacaataatatacccggattccgacaggtttaagcgattcttaaagctgtctatctatatagtgtttttcctgaaggcgttttaagccttttttgatttttttggcgcgcacttcgccgataccctcaacatcatcaagctcttctacagtggcttccgttatgcttggcaaaaatccgaacgcctcaaccacattttcaacaatcggcatcggcagacgcggaattttgttcagcagcctgtatcctctcgggagcacataatcatcaagattggtagaagccggatatccaagcagcttaaacagaatggaatcatcaagcagatcatagctggacatatcctgaagctcttttaacagcacgaacggatctttgattttttctttgacatagtctttgatgaaaagtgccgcctcttcttccatgtccgtaatcagttcaatcacctgcagacggattaagtggccttccgttccgagttctttaatatacatattgatttcattttttattcggagcaccatttcatatcgatgcatgacggacagcacgtcactgaatgtcacaagctcctcaaactctaatgcgtttaaagccgtaatcgttttgtctaaaatggttttatacttctcaagcgtttgaatggcctgatttgcctttgttaaaataaatcctatgtcctttagtgtgtacttcatgctgtcctgatataacgtaatgacatttctgcgctctgaaatggcgatgacgagacagccggtctgcttcgccacccgttccgccgtacggtgcctcattcccgtttctgaagaagaaatggtcgcttccggcataagctgcgtattcgcataaagaattttctggccggaatcacttaaaataatggcaccgtccattttggccagctcgtataagtgagcgggcgcaaatgatgtattaatatgaaaaccgccatccacgacttgctttaccttatcattgtatccgacaacaatcaggccgcctgtatttgcccgaagtacattctctatcccggctctgagcggggtgcccggtgcaacgaactgcagaattgcagacaggtcaagctcttgtttcgccccttttttctctttttccatctattatgatcctcctaatgaagtacgaagcgcttctgcaacatttgctactccgacaacctcaatcccttttggtattgtccatccgtctgcattcgcctcaggtataatcatgcgcttgaagccgagttttgccgcttcctttacgcgctgttcgattcttgacaccctgcggacttctcctgtcagacccacttcaccgataaagcaatctgcgggattcggcggtgtatctctgaagcttgaggcaatgctgacggctactgccaaatcaatcgccggttcatccagtttgaccccgccggcgacctttaaatacgcatcttgattttgaagcaaaagacccacccgcttctcaagcacagccataattaacgataccctgttgtggtcaatgcctgtagccatgcggcgcgggtttccaaaactggtcggtgaaatgagcgcctggatttcaaccagaatcggtctcgttccttccattgacgcaacgatactcgaacccgatgccccggcagaacgctcttccaagaaaatttcagaagggttcagcacttccgtaagcccctcttcccgcatttcaaagatgcccatttcatttgtggagccgaaacggttttttacggcccgcaaaatacggaatgtatggtgccgctctccttcaaagtatagaacggtatcgaccatgtgctcaagcaatctcggccccgcgatcgatccttcttttgtgacgtgcccgacgataaaaataggtatgccgtttgttttcgcaattttcatcaattcggccgtacactctcttacttgtgatacactgccgggagctgaggtgatatcactttggtaaacggtctgaatggagtctacgacaacaaatgcgggtttcatctcttgtatagcagacgaaatatactccatatcggtttcagataaaacatgtaacatttggctgttgattccaagtctgtcggcgcgcagcttcgtttgcttcacggattcttcccctgaaatgtaaagcacgctgccggccgtatcagctaattgtgcggatacttggagaaggagcgttgattttccgatcccgggatcgccgccgattaatactaacgagcctttcacaacgccgccgccaagcactctgttgaattcttcgagctttgtttgaacgcggggttcttccgatgtttcaattgatgtaatgggtgatggtttttggacggtttgaacggagtgggagaaagccgcccgccgattcgccggcgctttttttatggtttcttccaccattgtattccaagccccgcagcccgggcactttcccatccattttgcggattcataaccgcatgagtggcagatgaattttgtttttgatttagccatatatgttgtaagacctcttccttatcgaatatttctctatataacaaagtgaggcatacacttgcttacgtatgcctcatgtttgtcactatattagttcgttttagcagttgtttttacgacaaattcgccgtcctcaacatcaagaacaatgtgctggcctttatcaatattgcctctgaggagttcttctgataaccggtcctccacatgcttttgaatcgctcttcttaacggacgtgcgccgtattccaaatcgacgccctcttctgccacttttgcttttgcagcatccgtcagctcgatagagagatcttgttctttcagacgttttgttaactgatcagacataagcgacacgatgtctgtaagatgttttttctcaagggagtggaagacgataatttcgtcaatccggttgataaactcaggtctgaaggcacgcttcagctctcccattactttgtctttcatgtctttatggttttgtgattcatcctgcacattgaagcccacatatttgttgcgtttcagctcgctcgctccgacgtttgacgtcataatcaggatcgtgttgcggaaatccacagtgcgtccttttgaatcagtcaagcgtccgtcttcaagcacttgcaggagtatgttaaacacatcagggtgcgctttttcaatttcatcaagcagtacgacagagtaaggttttcttctcactttttctgtcagctggccgccttcatcatagccgacatatcccggaggagaaccgacaagacgtgaagttgagtgtttctccatgtattcggacatatccactctgatcatcgcttcctcatcaccgaaaatggattccgccagcgctcttgccagctctgtcttcccaacgcctgtagggcctaggaagatgaatgaaccaatcgggcgtttcgggtccttcagaccggctcttgcacgtctgacggcctttgcaacggctacaacagcttcatcctggccgatgacgcgggagtgcagaatgctttccatattgagaagcttatctgtttccgtttgggcaattttagatacaggcaccccggtccagctggatacaaccatcgcgatatcctctacagaaacttcggagttctcctggccttgtttttctttccaggtttttttcgtgtcttccacctgttctctcaggcgctgctccgtatcacgaagggaagccgctttttcaaactcctggctctgaacggcagcgtctttttccttgcgaacttcatcgagtttctgctcaagctcttttaagttcggaggcgttgtgaacgaacggagacgcacttttgaaccggcttcatcaattaaatcgatcgctttatccggaaggaagcggtcagaaatataacggtcggacaattttaccgccgcttcaatcgcttcatcggtaatggatacgcggtgatgcgcttcatagcggtcacgaagcccttttaaaatttgaatgctttcatcggctgagggctgatccacctgaatcggctggaaacggcgctcgagagcggcgtctttttcgatatatttacggtattcatcaagcgttgtcgcaccgatgcattgaagctctccgcgggccagtgaaggttttaagatattcgacgcgtcaatcgcaccttctgctccccccgctccgatcagtgtatgcagttcgtcaatgaataaaataatattgccggcctgacgtatttcatccattacttttttcaagcggtcttcaaattctccgcggtatttcgtaccggctacaaccgtacccatgtctaatgtcattacgcgtttatcacgtaaaatttccggcacttcattattgatgatctgctgtgcgaggccttcagcaatcgcagttttacctacacccggttctccgataagaacggggttattcttcgttctgcggcttaatacctcaataacacgctgaatttctttgcttcggccgataaccggatcaagactgtcttccttcgcaatcgcagttaaatcacgcgccagactgtccagcgtcggcgtgtttgcattgctgttcgtaccggatgcagaagatcccgtctcattgcttcccagaagctgcaacacttgctgtctcgccttattcaagctgacaccgagattattcagaactctcgccgctacgccttctccttcacgaatcagtccgagaagtatgtgttctgttcccacataagaatgtcctagctttctggcttcatccatgctgagctcaatgactttttttgctcttggcgtataatgaatcgtttgagacatttcctgtccccgtccgattaagctctccacttctttctgaattttatccgaaccgagtccgagtgcttggagtgctttagccgcaatcccttctccttcacgaaccagacctaataagatatgttcagttccaatattgttatggcctaagcgcagtgcttcttcctgtgccagtgccaataccttttgagctcgctctgtaaaccttccaaacatcatatcgaatcatcctcctgtctatttgcactcatttctaaatgcagcctttccctgataagagccgctcttctcgcgtctctttcgttcggccgtaatgcaccgcccgaatattgctggagaaaacccggctgtgtcaaaatcatcagttcattaagtatattgcttgatagccctttaatgatccccaggtctatccccagccgaacgtcagaaaggcatttcgccgtttcctttgattcaatcatacggcagttggataaaacaccgtaagacctgaatacccggtcctccaattcaattttcgaggtttggtaaagcgcttctcgggctgaacgttcctgctcaatcagctgggcagccacactgtttaaatcatctacaatgtcctgttctgattttccgagtgtgatttgatttgaaatttgaaagatatttcctaatgcttcgctgccttcaccgtaaattcctctaacaactaaacctaattggttaattgccggtataattcgattcatttgcctagttaatacaaggcccggcaaatgcatcatgactgaagcccttagtcccgtccctacatttgtaggacagcttgttaagtaccctctcttctctccaaaggcgtaatccactttctcctcaatccagtcatcaacctggtttgccgcttttatggcattgagaagctggaagccggggaagaggcattgaattctgatatgatcttcttcatttaacataatgctgacttcttcattttcagaaagcagacagccgccaaaaggggattccgttaaattcgggctgatcagatgtttctccatcagcacccgtttttccaaaggctgagcttcactcattctgattaaatgaaattgaccgatatcaggcagttcttttcctgaaaagtgatcttcgaattgctgaatgatggatgaggcttcttcattcgtataccgggcgggaaactttatattttcaaagtttcgggccaaccgtatacggctgctgagtacaatgtcactttcaggtcccttttgcttcatccaattgcttagtgcgtcctgaataaaatgcttgagcgacattacccttgttccccctcactgtctttactttttaacttctgctctaacgatcggatctgatccctgacctccgctgctctttcaaactcttcgtggtgtattaaagattcaagttctttttttaacatttccatttgccgtcttacatgcaggtttccgcctattcgttttggaattttcccggcatgcaccgtattcccgctgtgaacttttcgcaagatcggcgtaatttggctgtagaacgtatcgtaacattccgcacagccgaaacgccctgtttttctcagctgctgaaacgtcataccgcatttcttacaagctgtcccttgctctgaatagccgaacatttgagaaccggtgttttgaaatgaagactccatattcagcagccctgataataaattatggatcgagaacccttggtttccacttatactgtatgaatcgctattttcttttgcacattgttcacaaatatgaacttcttgtttttctccattaacaactttcgtaaagtgaaaagtggccggtctctcattgcattcttgacaaatcaatcttttcacccgcttactttagttttaaagatgtgagcattgctttcatcattctggctcttagttcatcccgttcgggcaaatcaatatatagaactgaacgatccattacactcaccatcattttagcttctctttccgatataactccgtcctctaacagtctgagaataatgtcatcagaggctgcctgggacaagtgggtatgaatctgcgaaataatattattgatgaggacgacttcgttattcattttaattttgataatacgaatatacccgccgcctccccgtttactttcaacaatatatcctctttcacttgtaaatctggtgttgatgacataatttatttgggaaggaacacattgaaatttatcagcgatttcactgcgtttgatctctaaaatttctttgccattttgatctaatacttgtttcaagtactgttcaatgatgtcagaaatattatgtcccactcaaccccctccttcattgactttgactatatttgactttaaccttactataaggtgtttcgcaaaatttttcaactgtatcgctctatctctattatttccactttgcacaagcataaaacctgcttttgcaaaaaggcatatcgttacgtttctcatattatataatgtatgcagaaaaacacaaaaaaggcagctcataatgagctgcctttaccgtaatgatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattacaattgaatgtgaattacttctgttatctagttttcaaagaacaacatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtgcgttttgtcttgtttagttttcaaagatcattttgttcactttctcaagcaactttttaagtatataataagtttctcttaaagtcaacatgtttttttataaatggtggagcctagcgggatcgaaccgctgacctcctgcgtgcaaagcaggcgctctcccagctgagctaaggccccgaagtggtcgggaagacaggattcgaacctgcgaccccatggtcccaaaccatgtgctctaccaagctgagctacttcccgatttttaaaaatattatggcgcgcccgagaggagtcgaacccctaaccttttgatccgtagtcaaacgctctatccaattgagctacgggcgcataacaatgaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcatacaggataactatcctgtataatgcgggtgaagggacttgaacccccacgtcataagacactagatcctaagtctagcgcgtctgccaattccgccacacccgcgtaacatggtgagccatgaaggactcgaaccttcgaccctctgattaaaagtcagatgctctaccaactgagctaatggctctttttaaaagacttatgttattatcttgtccaaaaatggtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatattacacttacgtgtaatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattacaattgaatgtgaattacttctgttatctagttttcaaagaacaacatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattttgtctttcgttcaagcgactttattattatatcttatcaatctcttgaagtcaacaactttttaaatttcttttttcgtcagcgccttgtttagcggcaacgaataataatataccacctcacaaataatagtgcaatagttttttaaaagaaaatcaaaaaagttttacgagcggcttgtttctaaaaaagcgccgtactgcgataagcagaaacggcgccttcccttttattagcgttgtctcatttgagggaataataaaacgtctctgatagacggagcatttgttaacagcatgacaaggcggtcgataccgatacccaatcccccggtcggcggcatgccgtattcaagagcttcaacgaagtcttcatccatcatatgcgcttcatcgtttccttcttctctttcttttaactgcgcttcaaagcgttccctctggtcgatagggtcattcagctccgtaaacgcattagcgtgctcacggccgacgataaacagttcaaaacggtctgtaaagcgagggtcctccggatttttcttagcaagaggagaaatctctacagggtggccgtaaataaatgtaggctgaatgagtgtttcttcaattttttgttcgaagaattcattgatgatatgacccaccgtcattgagtttgtgatctcgataccatgctcttttgcatgaccgcgcgcttcttcaacagtcatctcattccagaaatctacacctgtcgcttctttgaccgcatctaccatgtggagtcgtttccattcaggtttcagatcaatctgctcttcgccgtactggattgtggtgcttccaagcacttcctgcgcaatatgtgctacgaggttttccgtaaggctcataatatctttataatcggcgtacgcttcatacagctcgatcatcgtgaattcagggttatggcgtgtagaaacaccttcattacggaacacgcggccgatttcgtagactttttccaatccgccgacaatcaggcgtttcaggtgcagttcaatcgcaatacgcatataaagaggcatgtcgagcgcattatggtgcgtgatgaacgggcgcgcagacgctcctcccggtatgctgtgcatcgtaggtgtttcaacttctaagtatccatggtcatctaagtatcttctcatcgcttggatgattttgctgcgtgtgataaacgtttgtttgctgtcagggtttacgatgagatcgagatagcgctggcggtaacgctgttcaacgtcttttaacccatgatatttatcaggaagaggacgcagtgcttttgtcagcagttcaaaagatgtcgctttgacagaaagctcgcctacgtttgttttgaaaactttccccgtgatgccgataacgtctccgaggtctgaagatttaaagatttcatattgttcttcgccgacactgtcttttcttacgtaaatttgaatttgaccttctaagtcctgcagatgcgcaaagccggctttcccttttccgcgctttgtcatcatacggcctgcaatggtcacttcgaccgctttttcttccagttcttctttagaaagctcctggtaggcgtcaatgatctgttgagattgatgcgttctctcgaaacgttcgccgaaagggtcaatgccgttttctctcagctggttcattttatctcgtctgacttgcagctggtcgttcaattcctcatgattttgctcttcttgactcattggtatcactccgttacattttgatttcacgaaaaagcagaaaaactgccagcggtaagctggcagtgagcagcaatagagggtgtatattaacctacttttgcatcttgaagctcttttgcctctgcttcggcggtaaatgcatctaaaagctgcacaacttcttcacgcgtctcacattggttaatttcgttgcgtacattcgcattgcctctgacacctttcagataccaggcagcgtgttttctcatttctctgactgccacattttcgccttttaacttaatcaggcggtctaagtgcagtttgcataccgacattttttcacggactttcggttcgtcttttaactcgccggtttcaaggtagtgcaccgtacggtaaatcatccacgggttgccgagtgcggcccggccgatcatgacgccgtcaactcctgtttcctcaagcatgcgtttcgcgtcctgaggcgttttgacatcaccgtttccgatgacgggaatggagacggattgcttcacttctttaatgatatcccagttcgcagtgccttcatacatttgcactcttgtgcggccgtgcagggcaacggcttttccgccggcacgttcaacggcttgggcatttttcaccgcataaatgtgctcttcatcccaacccattctcatcttcactgtaaccggcttatcaacagcatctactactgcggataccatttcataaatcttatcgggatcgagaagccatttggcgcccgcatcacattttgtaatcttgggtacgggacatcccatgttaatatcaataatatcagcagtcgtgttttgatctacaaacttcgccgcttccacaagggtttccttttttcctccaaaaatctgaaggctgagcggtttttcacgttcatcaatgtaaagcatccccattgttctggcgttattgtaaagaatcgctttgtcactgaccatttcagcgcataccaatccggctccgaattcctttacagtcaatctgaacgctgagttgcagacaccggccataggggcaagcacaacccggtttttcaattgaatatcaccgattttaaacatttttcccctcctttcatttgtctatttttcaggcggggccaattcgtccgcacttatatttaaaacatctgccgcatcttgaatgatggcatctgacggcaaccggtttccgcgttcaatttcaccgacaatagaaactgatatacctaatgcttttgcaaatccttcttgagtataacctttcagctttctgaatgcacgaattcgcctaccccagatttctgcttccatactcttacaccttcttggtttgtttcagcgcttatcgtgatatgatccgcctgcgggcatatttcttttaacggcgcaaggacaaataagcgctcatacattctcggatgcggaacaatcagccgctctgtttcaatattttcacgattatacagcaaaatgtcaaggtctgccgtccgcggtccccagcgaatctctctcgttctgcctaattcagcttcaatgctctgcgttacatcaagaagttcaaaaggagataacgacgttttcacttcaaccgccatattaagaaactgatcttgatcctcatagccgacgggatctgtttcatatatggaggacacctttgacaccgtcacgccatgatgccggctgagcatggccactgcctgacgcaaataatgttcacggtcgcccatattggaaccgaggccgatatatgccgtattgttcatgatttctttctcgtcatttctatggctactgatttataatggccgggaatcggcgggtcaggcttaacaacttttaccgtacattgctgcaccggctcaaatttctcaaggacggtgtctgcgatccgttccgcaagcgtctcgaccaaattgacgggttcgccctcaacgatgccgcggcagacactgtacaattccgcatagttaatggtataagaaaggtcatccgtttttcccgctttgctcaaatccagttcggcagtcaggtctactttgaagcgctggccgagtttgttttcttcttcgaacacgccgtgatatccgtaaaactccataccttccacatatactttatccataatgtacgcctcctttgttcaacatagcatccatcatcttcgtcattcttgcgatctctttgacatcgtgcaccctcacaatgtcgcagcctttttggacgccaaggcatactgtcgctcccgttccctcggcacgttcttcagggggaaggtcaagcacacggccgatgaacctttttctcgatgtcgccagaagcagcggataacctaacccgctgaacacctccagcttgttcatgacagccagattgtcctcatagtttttcgcaaagccgatccccggatccagaatcatattttcatctgtgacgccggcttccgcggcaatttttacgctttccatcaagtctgcaagcatatcaggaataagatcgttgtagtttctttccatgcggttatgcattaagataatcggaaccccgtgtgcggcggctactgacgccatgtcaggatcacctttcgccccccagatgtcattaaggatagaggctcccgctttgaccgcttcgtctgccacggacgctttgtacgtatcgattgaaagcggaatgtccagctcgcttgtgatccgctctatgacagggatgactcgtgacatttcctcatcagccgacacgagtgatgcgccgggtcttgtcgattcaccgccgatatctatgatatgcgccccttcttcagccatcttcgccgcatgcagaagcgccctttccgtactgtcgtatttgccgccgtcagagaaggagtctggcgttacatttaatatccccataacgagcgtcttctctttataggaaagagtgcctttttttgtatgaatcagtttaggatgttcaattgtttgctgcgccattttgttcctcctcctgtacattcattttgtttatttcctgctgatactgcttacggagcaattgcaccgtttttccgctcactccgggcagcggcacttcctctattttagaaaacgggatgatttcaagcacggagtttgtcaaccatgcttcatccgcttcaagcattgattgaaaacggaatcgaccttcggtgacttctgtcccctgccgtttcaattcatcaatgacaaactgtctcgttacaccatcgagaattcccgtatccaaggatggcgtaaagaccttgtctccttttcgccaaaacacgttggagacaatgccttccgcgacatctccttctccggtcaggaaaatgccttcaaaattgggatcattcccgatctcccgtttagcatacatgttgtttaaatagtgatgggattttaaccggaaatatccttcaggcgtatttctcctgatagagagaagcctgccttctttttgaacaggcagagtttccggattgagccggttgacgaaacaaaggacggtcggcttttcataagtctgcgcggcaaaccctttatcgctgacgcctgccgagatgttaagccggacacgcgcgctgccgtccttgatctcattgaggagcaacagtctccgaagcatatcaagcagctcctgtttgttcacctcatatgcaatctgcagatcccgaagcgccctgttgagcctggcgacatgcgcatccggcagaaacggccggccgctgtaaagcctgaacgtctcgaacgcgccgatcccgtacagataaccatggtcaaaaggagaaagcgccgcttctttctcctctatatattgaccattcaaatatataatcacaccgtcacttcctttttgcggtgtgtctctataaagtttctgagcatctctttgccgaaggaggtcatgatggattccggatggaactgaacaccttcaacaggcagctcattatggcggattgccataatttctccttctttggtttgagcggataccgtaaaacaatccggcagcgtgtccgctttgacaataagtgaatggtaccgggtggcgacaagcggattttgcaggcctttaaaaatcgtctgtccgtcatgcataacttctgacgttttgccgtgcatgagccgctccgctctgacgacgtcgccgccgaatacttgcgcaatcgactgatgtccgagacatacgccgaaaataggaatactgccggcaaaatgtttgatcgcttcgaggctgatccccgcttcatcaggactgcacggcccgggtgaaatcattaagaagtccggacccagctcttcaatctgctcaatcgtaatctcgtcattccgtctgacgatcagttcctccccgagttcacccaaatattgaaccaagttgtacgtaaatgaatcataattgtcaatcattaaaatcatctctgctcacctcgtctgattttttgtctcttcttcgctcagctctaacgcctttttcatcgcaaaagcttttttgaacgattccttgtattcatgcttcggaaccgaatcaatgaccactcctgctccggactgcataaaagcatgtccgccggctgcatagatcgtccggatcacaatgttaaactgcaaatctccgttaaatccgaaccagcctatagatccagtataaagcccccgtcttgtcggctcaagctcttctataatttccatcgttctcactttgggcgctcccgtgatggtgccccccgggaataccgcatgaataatgtctgtcgcgtcatatccgtcctgcagctctccctgtacgttcgacacgatatgcatgacgtgggaatacttttcgatcgccataaattcgttaacccgcacggagccgtagcgcgatacgcgcccgaggtcattgcgctcaagatcaacaagcatgacatgttccgcacgttctttttcgttgtgaattaattcatcagccaaagccttgtcttcagcatcgtcttttcctcttgaacgcgtacccgcgatcggtctcgtttcaagcttcttccccttctttgtcaccaatagctccggcgacccgcatatcacttgaaaccccggtgtctcgagataggccatgtaaggagacggattgacgtttctcaagtgtttatacacctcatacggatgaacggataaggactgagactgcctgatggacaaattcacctggaacacatcgccgctcgtgatatattgtttaatttgttctacagcctgtgaaaatccttcctcagtgaacggagcggcgtacgatccgtccccattccgattcagcggtgaaaaaggctcgtccgccgtttggagggaacaccacatgtcctctaagcgggacagcttttcttccgcaagatccgcttcttccgcttcagtatgggtaatgagccataacgcctcttcctcatggtcataaacggccacatcatcaaaaacaagaaagtaaatatcaggtgtttccagatcatctaacgacagcatcttaaaattctcaatatatcgggcgtagtcgtaactgataaaaccaatcgcaccgccttgaaagtccggaaactcaacgtttgtttccgttccgagcgttccaaaccattcatgaaaggcccgcagcgggtcaccttctttaaacagtgtttccccctcatgcttgatcgttgtaattccgtcttttcctctgacggacgcaatcggatctagaccggctatactgaatcttccccctctcgcgctttcgagcagaacatgccgttttctcgatttcgaaaggttttcatatcgctgtaaaaatgcttgtttcgtaaaaggtatttttcttcctgccggtctgcgttgtgccatcatatcaatcctctgcttcgttttactgtagttttattttaaagcaatcacactggtgaaaaaagtgaatttcacttccaaccataaaattcgaaacgttttttggattttcgatgcttcaggcacaaaaaaactcccggatacagccgggagccgtgtgtatgtctctattcaaactgataaagcggtgtgcttaagtaacgttctccgttactagggatgatcgcaagcactttcttgcctttccccaattttttcgcgatttccagtgccgcgtaaatggccgctccggaagaaatgccgccaagaatcccttcttcttttgccgttttacgggcatattcaaatgcatcctcgtttttgacgggtatgatctgatcatagatgtccgtattcaatgtttcagggacaaatcccgctccgataccctgaattttatgcgggcccggttttccgccggaaagaactggagaatccgccggctctaccgcatagattttgatggatggatatgcttctttcagcacttcgcccgctcccgtgatggttccgccggtaccgattccggccacgaacgcatcaagctggtcgtcaccaaactgttctacgatttctttccctgtcgtttggcggtgaatttccgggtttgccgcattgttgaattgctgaggcacaaagtatccgtgttcctcggcaagttcttccgcctttttaatggcgcccttcattccttctgcgccgggagtcagcacaagctccgctccgtatgcgcgcagcagattgcgtcgctccatactcattgtatcaggcataacgagaatggctctgagacctttagccgctgccaccatcgcaagaccgattcctgtatttccgcttgtcggttcaatgattgtgtcgccggcttttaattttccttctttttcagccgcttcaatcatcgccactccgatccggtcttttacgctgctgcccggattcatgtattcaagcttcagatatacatctgcactgttttcatccgtcaggcgattcaatttcacaataggagtatttccgattagttcagtaatagaatttgcaatacgcaccatgttggacacctcaatttccgactaaatttattggtattataaatataagttatcaatttcaaaattttttgtcaatcatttagttcttttttccccgtagaaccaagagacccccgcctctttccacagcgttttgactgtcgccttgtcacctaattgatccatcgcgatctggcgtctgatttggctcttcacttcattgtatgagaaagttctcgatttaagcttttctttcagctgaatgacggcgtatcctgaagaaactttaatcggttcagcggaccattcatcttctttaagatttttagcttctgtgatatatgcctgcgggatattttcctgattttctgtcacaaagccgaggtctccgccatactgtgacgtgtatctgtccgtggaacgctcagcggcgacggcttcaaagctggaaccgcctttcaaatcagcaagcaccctgtccgcctcatctttgtttttgacgacaatgtgccggattctgtaggaatcatcaaaatggtacaattctttatttttattataaaatgattgcatttccttatccgatatatcgatgtccttcgtcagcagttcttcaagaagaatgttgtagcggatctggtctctccattctttttcggtaatatggctgtcttcataaaatgaattatctaccgctttgattaaaagaaattcccgctccaattcgctgtttgaaactgtaagtttattctttttcgcaagctcttccactacttctgcattaatcatgtcttccagagttgattttccgtactggtcttccatctttttcatccagtcttgccgtgtgatatgtttatcaccgattgtcgcgatggattcttcagatgaccccgcggcttgggattttgttaacttatacgccactatcacactgcatactaacagcgccgctacaataatcgtcaaaagtgttctcgatttcaaaatctaccccatcccttttataaaatagaacaacccgctaaagagctagcgggttgtttcgtcacgaagctcttccagttcttcttttgtaaataaatatttctcattacaaaaatggcaaaccgcttcggcttttccgtcttcttctatcatatcttgtatttcttttttgcctagtcctaaaatggccgtttcgaatcgatcttttgaacaagaacagtgaaatttgaccggcattgtttcgagaacgtccggtttttgacctagaacttcttctaagatttcttccggtgtcaggcctttttgaatcaattttgaaattggttcgatttgagataattgcttttcaattgttgaaatggtttcttcatcagtccccggaagaagctgaatgatgaacccgcccgcagcgagaatggtgttatcaggatttactagaacacctacgccgacagatgaagggacttgttcagaagaaacaagataatatgtgaagtcgtcaccgagttcacccgagacaatctctacttgtcccgtaaaataatcacgtaagcccaaatcttttacgacactgagtgttccgtcagttccgaccgcccgtctgacatccagtttcccttgttcattgagatcaaaatgaacgtgcgggtttgatacgtatgctcttacctcaccctttgcgttcgcatctgcgacaatggctccgatcgggccgccgccttctattttgactgtcagcttatcttcacccttaagcatcgctcctagcatcagagaagctgtcatcgtccggccgattgcggctgatgccgtcggccacgtgtcatgccttctttgcgcttcattaaccatatctgtcgttctggctgcataagcccgcactttaccgtcatatgcaattgctttaattaaataatccatcgtttacctcctatacgtgacccacgcgatttcgctcataaatgatttccagccctttcagagtgagaaacgggtcaacaatatcaatacaatctgattcgtttgcgattaatgacgcaagcccgcctgtcgcaatgactttcggttcctgtgttgcctgccatttcatccgctttacaatgccttcaacttgtccgacatagccgaaaaggatgccggactgcatggcgcttaccgtgtttttgccgatgatattgtccggacgggcaatttcaattcttggaagcttcgccgcacgtgagtacagcgcttccgttgaaattgtaatgccgggagcaatcgcgccgcccatgtattgtttgttttcatcaatgtagcaatacgtcgtcgccgttccgaaatcaacaacaattaaggggccgccatactgctggatcgccgcaacggcattgacgatcctgtcagctcccacttctttcggattgtcatactttatatttaaacctgttttcattcccgggccgacaacttgcggctcgatgtgaaagtattttgtgcacattctttctaaagagaacataatcggcggcaccacggatgagatgataatcccttcaatctgttcaaacatgagtccggaatgttcaaataaggagcggagcagcatgccgaattcgtcttctgttttgtgcctgctcgtttctatgcgccaatgatattctaattccccatcatgatatacaccaatcacggtgttggtgttccccacatctataaccagtaacaacctctatcaccacttttgaatagtttctaatcataacattttcaacattctacaataccatacacgatctgcggctcttttgtaaacaaaacggaaccagtaaaaaaaccgccggtatacgccggcggttttcatatcagaaagcgaactattctttcggctcgtctttcttttcgtcttctgttttagacaggatgtttactttcacatcgtctttttgaagatggtcatctgagaaattgcgctcagggagttttccgtgatccacgagatgcttgatttgttccgcatctaatgtttccacatcaagcaatgtctgagcaatcaattcaagcttatcacgattttcagtcaggatggttttcgcacgctcataacattctttaatgatgcgctgaatttcctgatcgatttcgtaagcgatctgatcactgtagttttgctcgttgttgaaatcccggcccaggaatacttgaccgccttgagattgaccgaactgaagcggtccgagtttttcagacataccgaactctgtcaccattcttctcgcaatgttcgttgcccgctggaagtcattgtgagcgcccgtgctgacttcgccgaagataatttcctcggcaacgcgtccgcccagaagaccgacaattttatcgagaagttcaggttttgtctggaagtaacggtcttctctcggaagcatgaccgcgtatccgccagcctgccccctcggaacgatcgttactttatgaaccatatcggcttcatccagcacaagtccgataacggtgtgaccgccctcgtggtacgccacgatattgcgttcttttttcgagatgacgcggctcttcttcgcaggacccgcaatgacacggtccgttgcttcatcaatgtcgcgcatatcaattttcttcttgttttgacgggcagcaacgagtgccgcttcgttaagaaggttttctaaatcggcgcctgagaaaccgggtgttcttgaagcgattgcttttaagttcaccgtttcatcaagcggtttgtttctcgcatggacctgtaatacggcttcacggccgatgacatccggacggtctaccgtaatctgacggtcaaaacgtcccggacgaagcaatgcagggtcaagaatgtccgcacggtttgtcgcagcgataataatgattccttcattcgcactgaaaccgtccatctcaacaagcagctggttcagcgtctgttcgcgttcatcatgcccgccgccaagacctgcgccgcgctgacgtcccaccgcgtcgatctcatcaatgaagatcagacaaggcgcattctttttcgcattttcgaataaatcacgcacacgggaagcaccgacaccgacaaacatttcaacgaaatcagatccgctgatgctgaagaaaggaacgcccgcttcaccggctgaggctctcgcaagcagcgtcttaccggttcccggaggtccgaccaacagcacgcctttagggattctggcgccgagctcggcgaatttgcgaggatctttcagaaactcaacaacctcaacaagctcctgcttctcctcatccgcgccggctacatctttaaacttcacgcgtttcttttcttccgtatacagcttcgctttgctctttccgaagttcatgacacggctgccgccgccctgagcctgattgagcaggaagaaaaacagaataaagatgatgacaaacggaatgatcgtcgttaagaacgtcacccacccgcttgtttcctgtgcgggatcaacttttacgtccgtctttttaattgcatcaaatatctggtctgctccttttccttcaggaacatgtgttaaaaagtactggtctttgtcgtattttttcagctgtccttttacctcataaacacctctgacaggctgaaccgatacgctatcaactttcccttcatcgaggttcttgataaacgtactgtacgacatattttctgttttcgggtttgaagtctggaagtaactcacaaccccgattactactaataaaataagtaaataaaaaatggtattacggaagacccgattcattccttacctcctcccacagtaagcacaactatgttcaatagtaccatagaaaatcattccaatacaaccgataaccatctcggaagcaggcagccgatcagctttcataaatcgccggttttaatactccgatgtaaggcagattgcgatagcgttcggcataatcaagtccgtaacccacaacaaacgcgtcaggaacttcaaagcctacgaagtctgctttaatgtccgcttttcttccgcttggtttatccaacagggtaacaatcttaattgatttcgctttacgatatcggaagagttctacgagatagctcaaggttaacccactgtcgataatatcttcaatgattaagatgtcccggccttctacagatgtatccaaatctttgatgattttgacttctccggaagaaaccgtggaatttccgtagcttgatacatccatgaagtccatttccaaatatgtatcaatatgctttataagatcagccataaaaggaagcgctccctttaacacaccgattgccaacggaaacgtgtcgctgtactcgcttgttaattgttctccaagctgttttactttcttctggatctcatcttctgagatcagcactttttcgatatcctgtttcatgttaatgcttgccccctacacttttcatgctgtctatattgtaatacaatgcggtcactgtttgaaatcacaagatcgtcaaagatggattttttcaagccaggcagccagataatttcaccgctcgcatccgttacaatcggccattcgtcccgatcccgcagaggcagtttatgatcaataaatatatctttcacctttttcgagccattcatccctttaagtttgatccggtcgccgatttttctcgtccggattgttaaaggaaattgcaccttgtttctgcttgtcataaaaacagcattcccatttttgatatgagggtcagcctgatcggccacctctatcataaagccgttggggagaacagcagtctcgccttccgctccttgcagctgcagctcaaagggaactttttcacattgccattgttcaaatgtaaacaaacatgtctgatatgatttgaccaccttcagccctttcggaaaatcaagcactcccgaggcgcttccattttccgcccattcgagaaactgctgtatgtggcgggcggaaaacgacgatggaacgttttcataaagatagtttaatattagttgaactcctcttctttgtaaaggtatcggaagggcaagcaattgagaggaattgacttcaaccgatgtgtcagacttgcttgtaataaccttattcattcgttctttcgttaatgactgcaggtattgttcgtcttctgtcagtgcttcactcaccttttgaaacattttatgaacgtcaggtgattcatgttttaaaaaaggaagcacggtctttctgaatctgtttcttgtataatcgtcttttgcattgctctcatccgttctgtagctgagcccttcttgacggcagtattcaaggatttcatcctttgccgcatagaggaaaggcctgatcagccagccggatgcaaattcgcggacgggctgcattcccgcaagccctgccccgagcgtacctttcgcaagcctcatgagcattgtctcaacctggtcatcgccgtgatgagccagcgccaaaaacttcgcttggtgttttgtcatcagatcttcgaaaaactgatatctgcaatcacgcgcggcagcctgcttgttcagcttattcttctttgcgtatgcagaaacatcaatctgtaccgtttcgcagaggatatgttccgcttcgcaatatgactgcacaaacttcatatcttcttcagattcaggacccctgaactgatggtcgacatgcgccgctatgataacggaagaatgcccgaagtgcttattcagcatactgagaagcgccattgaatcagggcctccggagaccccggcaataatcgtttctccctccgcctgaagatgatatgttttgaaaaaatcttccacgcttttcacaatgtccccctcacaatgagcaggttttttaaagatatacatatcctatcactttcattccctccaagcaaagaagaagcatgagcgcaggcgtccggccggcactagatgagaaaaaagacgatgtaagcgaaataaagggcgagaacgctgattaaaataagtgttgtttcaaacaaaccattgtgctttgcgggtttttgtttaggtttataccgcgtttgagatacagtgccctgccgcggttttgattgcggcggcttaggcttggcggcggctttccttttactccctgcactctgccccgccgtcaggatgtcatgcttcatggcttccgcagacggatattggccgtttaaagcagaaaacagaaccttcttatacttattcagaaacgggtggccttcaatgatagaacgaagctgttctttcggctgtcctgactttttgcactctttcttctggacacagtggatcatgatcattgcgacagcaaacaggtcataggatggttctgcttttcttgttccatacccccaatagcccctgtcgtaaaactccgtatactctttaatcgcgcggccctgttttgtcgttccccctacatcaatgcagcgaatggcagccggtggtccggttacaatgagattgtccggtttgaggtcgccaaaaacccacccttgctgatgaaggactgacaggctggaaagaagctgcaccatcagcaccggaatccactccgctcccttactgctgatatattgcggaagaagcggcccttctatgtactccatcacgtaaaaagagacatttttattcagctgcggaataaacgcgtcatccgcatcaaaaaaagaaggccccatcgtttgcgaccgggcctttgaaaaggattttaagacattcacttcagaggtaacagacatgctgtcgctgcttattttcaaagcgacctgtccgcctgatgcttctgccagatatacaataccgttagccccttttccaagctgtttgagcaatctgtaggatttgccgttccatttgccctgaattgccgtccccggtgccagactacatgccaaactcgttaaagcgtcgttcatcatctgccaacatgctccttcttgagcggattctctcaaactgctgcgtcgcttcccggatagcggggcccgtaggggtgataccgccggtcgacagcttcgcaaagagtgcagaaagggattcaagcttcggcgtccaattcagcacaagctcaacttcctggcttttcccgggaaatatacacattgcaaattcattttgcccggcccgggaatttaaactgatggaaagatcgatcagcgcttctttcaccgtcggcagtttcggcgccatactcgcactcgtatcaaccagcacaagcacttgcagatgaaccgtttcgccgagttcatcaaccacttccatcacttcgccgcgtttttcaggagaaagctcttccatttcaacgtttttccctaagatttgtttaagctcttgattgacgacaccttgcagcgtctgggtcattgcttttttcgtcaccatttgaaccgtctgagacaattgtgacgcatacacaacttgatggacgccgcctccggccatggcgatgccttcaacttccttcattgcctcttggtcaatcgcgttttcttccataattcctataacattcaccgtaatcccctgctccttggcgaaagccgccattgcgatcgggtcttcaccatgattggagcagccatctgtaatcagcagaacttgatttaaatgtcccttattcacatacattcctcccggtgatacgattagtcccatcttcgccagaaggaaagtgatttatacgaaatgattaagaaatctcctttttattttggaaaaccgccggcaccggtatggaagcccatttcggcgtgttgtggtcaatccggacaacaaccactgtcatatcgtcttcgatttggccggaacgcgttctgatgacctcttccattaatatatcagcgatttcttgcgggtcttcggttttcagccctttcattttccgtttcatccacaggtcgtggttttcaacgtgcttcggcccttcaaaaataccgtcactcatcatgacgagcagatctcccgcttttaactgttcacttacaacctccacgtcaaattcattgatgatgccgatcggcagattgctggcctgcactttcatgacttgatctccccgcttgataaaactcggcgttgaaccgaccttcaagaatttgcagcttgcatcctgaagatcaatgatagaaagatcgagagttgagtagatttcgtctgtcgtccgtaaagacagaatactgttgatcgtttttatcgctattttttcatcaatacctgattcgagaattttttcgagcaacttaatcgtttcattgctctcataatgggccctcgccccattgcccatgccgtcactgatcgcggccgcatattttctcgcccccagttccatcatgctgtagctgtcgccggagacaaggccgccgccttttgccgcatgagccgcgcctgtcgatacccggtacgacttggtcgaaccgaacgcaacatggctgtagccattcggatgagtcgagtgctgttcgcttttgacaagtatctgctcctcaagaatgtcagacagcatcggggcgataattttctcactctcgccgtgtcctccgctgaacgggattgtcatttcgatatcaatattgccctgctccaagctgtatatctcgacatgctgaatctcgattccgaaatgctgaagcgcctctatcatttgttcttcctgaataaaatgctgctccctctcccgttttatttcccgagaaaagtccgccatgacctcagaaacccccaacagctgctcggcaacaagccttctgctgtcctgaacttttctcttcagtgtcagatgggcgtgatggtgggcaagttcgtcctcaatcagctcttccacctgtctggatttggaacagtgctgttgaaactccttttttaatctgcggtttgaggcatactgtttttcttctgtttcatgcataacttgtttcattaagtcatatgttttatcaaagttttgaacccagcatttgcttttcttatagcaggattggcaggaatgctccgtgattttgcttaaaaagagatccacttccccttcttccgcctgctcatcagaagacgtctgatgaaaggtggcgaagctctccgacaaggcatgaaacacattggagaactggtctactttctgggcggtgacatctctgattttcctcgcgtactgctgctgttcctgactgtgctcagcagtgcccggtatgtatcgcgccacctttttcgtaatcgattggggcgtaatcaaaaacaaaacaacggcaatcaaagattcataaagagtggtcattaatccggcagatccttctccatataatgaaatcagcagtgagccgatcactaacccgactgcggctccggctttctttccttctttcagcagcccgccaagaagcccggaaaacgcaagcagactcatttgatagaggttcccgatattcgcaagcccgaggatcagtccggtcaccacaccgaccgtacagccgatgcttgccccgccgacaaaggaaaaactcagcacgacatagcgggccaggatatgttcagcctgcattccctgaaatgaaacaccggcaagcccggttaaaacggatgcgatcaagatcataaaacagatgatttcttctatttttaacgtttgcttcacttttttgatcgtgaaaatcggcaggctttgcaaaaagatcagcgtcaaaataaaggccaggcccgcctcgacaacagccatcacataatcataggtggtaaaagcgccgctctcaaaataaacaaatccgattctcgcggcagccatagagaaaaacaccacgatcggcagcatcttcacccggtcctgcacgatatatgtaccgatttttgaaagtagagtgaagacggccaaagctgtgagaatcaataaagagtgtttcggcgaaatggttaaagcgcccgcaagtaaagacagacaagcatagaaggctttatctcttctgatcaaaagcatcgctccgaaaaacggcagcgcaaacggaagaacctcagataatatgaaagcccgtccaagtaaaaaaccgatcacgacataaatgaaacccttatagaaaaaaagtgaatgcgcttgatggactgtaagctttgccgccttttcaaaaaacgattgcagtttttccagagcttgtcccgccatcggcccgttcactcttctttccgctttttccattgctctcatcccccacctgttttattcgttgcttgtcattataaatgaaagcccagataggattttgtcaaaagaaggtaacaattccaaagaactcttcgacgctttctcccttgttcccctttcctttcgtatttcctccgacatttctcaaaaagttgtctaaatatgaaaaaatcggcttctgcaacagaagccgattcgcttgatgacccgtacgggattcgaacccgtgttaccgccgtgaaagggcggtgtcttaaccgcttgaccaacgggccagatatatatggtagcggcggaggggatcgaacccccgacctcacgggtatgaaccgtacgctctagccagctgagctacaccgccatataggtgcttataagcacaagttatataatacaaaggtttcttcattccgtcaacagaaactttaaagttttaattttctgactataatggcgcgtacaaaaaaagcacccgctgggatagacggatgctccatgtatttatagaaagcagcaagttatcctcttcttgctccgcgccctccacgttttgattccgtgtttcgttttaaagatgataagcggtcttcgctatctttaagaaacttgttcattttctgttcaaaagattctttcggacggaaatcatttctaggtctggcttgcggacggtctttagcttttttaattgataaaccaattttcccgtctttttcaacgttgatgactttcacttcaacttgatcgccgacttttaaatgctcgttaatgtctttaacataattatcggctacctcactgatatgaacgagaccggttgagcctccaggcaattcaacaaatgctccgaaatttgtaatacctgttattttcccttgcaacttgctgccaacttcaatcgacataaaaaaagtgctcctccttaggcttataaaaagatcgtttgtttaattatacctaaataaaaatttaagtgtcaacaaggctacttgctcttcttttctacattgaagagaatctcaccatttcctgacataaacaagtctcttctggcaagctctgtgacgtaatcctcatcctttaatttggaaatttcatcttttaaatcagcctgtttcgcgttcaattctttcacttgtttttccagctgagctttcttttcttcgtttgcgctaagggaagaggtctgtgaccacagagaacccgctaagacaatagccgtcaacaacacaagggcgccgaatacgatcaaccgtctgaaaagccctttccgccttcttttcataagctgggattgccgttcaacctgctctttatagtcgttttggatttcagttattgtacgttctctagatagattcaaaccagacggtcctcctttcaccttttcaaaatacgtatcatggtcgatctgattgttatgattagtttcttgctcttttgtaaaaatcctgcacttttttgaaaatatcgtttgaaagtaagacgccacttttcaggaagaagtttcaataattgtttcaacaggaaaaacagcggatacagcaaaaacgttacgatcttaaaaagacacttcgcaaaaaaggcactcacccgataggagtataaagaaataaccgtgatcagcccgatgagcagcttaaagagcagaagcaccggacggaacagcacgtgctgaatgagcttttttgcgaattggtaaagagacaccgcaagatgaatggcaaatttcagtatttttatatacattcgtttaaacaggctttggtacgtcgcaatccccagtaagacagccaagaaaatgtataccctgagttccccttcattcacgttgagcagcacatagaaaaacagcagaccttgtacaatccaaaagagaatgtcatgaatgaataacagccatctggccgttttggcgcggctgacaaacagcctgtatgtatcaagcgacgctccgagccaggcgcccataccggtcattgccagcatcgtataaaattgggtggtcagcgtcatttaaacaacttgctaaaaaaccctttagctttatccccttgctgctcgtctaaatatacaaggtcaaacaccctgccttttatagatacaatccctttttccacatcaagatttttcatctgcaggttctcgcctctgacggaaagcattcccataaccgtttccagcaaaaactcttcgttgtcaaaactttctacatgcttgacgcccgaaatgtctaaatgctttctccctttcatcgttacatcatgctgttccggaacagaagaagaacctttttgctcataatatgaattcatctattcagcccccatatcctcgatacttttagcattattactgcattgtatgagacgggagccttgtttagaacaagcctattcgccgagtttttcttccttgacgattgtatacatgcccgcggcttcttcttttttcgttgtttctttcaattcgtttaccttcacggtgacaagcttctggccgaagcggaccgtcagttcatcgccggcttttacgtctgagctggctttcgcctgattcccgttaactgtgattctcccttgatcggcgacctctttcgccaatgtgcggcgtttaattaatctggatacttttaaaaacttatcaagtctcatatcagaatctcctctccatttcttttgcttcatcccacaatttgtccatttcctcaagtgacattgcggtcaattcaagtccctttgctgccgcttctttctcaatataagcaaagcgtctgcggaatttgtcatttgtcatggcgagcgcttcctcaggctcaattttatagtatcggccgatattgaccaatgcaaataaaacatcgccgaattcagcttttaagctgatttcatctgctgattcggcagaagcctctgcagaaaattccttcagctcttcatttactttatcccatatatcctgaacgtcatcccagtcaaagccggtttttgcggcttttttctgaagcttggccgcttttgcaagagaaggcagtgttttcggcacggcatccagcaatgaagtggatgttgtttgcttttccgcctttttgatttcttcccagttggcgacgacatcatgttcatcctgaaccttaacatccttaaacacatgcgggtgccgtctgaccatcttcgcactgatgtctctgatgacatcatcaattgagaaatacccctcgtcttctccgatctgggcgtgcagcataacctgaagcatgacgtccccgagttcttctatcatgtgatccgtgtcctcttcgtcaatggcctcaagcagttcgtagcattcctcaatcatatatttctttaatgactggtgtgtctgcttttgatcccacggacagccgttcggcccgcgaagctcgcgaataatacttcggaatgcagaaaattcctggtaaaggagttcttcttttttaatcggcggaacatacacgcttgttaagttatttatttctacattgcggtcaagctcaaacaaaggcaccttggtcatcttttctcccttgcttccggctgccgtgacgatgaccacttcatagtcgtcaggcaatttctccataagcgtcagcttcacctcagaggccgtcatttgatcataaacctggcaaatgatcaggtgatggcggagttcgagctcatccggcgtcattgtttgcgcatccgtaaattgaaacccttcaatcggatcaattcgcaatgcattaaaagtggcatccaaaaagctttgccctccggcagtatgaacagctacctgttgttcttcccggcgttcaaataacagctgaacggttttctcagcgacaaacggatgtccgggaacagcgtagacgacatcctcttgcttcgctttttcaaacagaatgtccgcgatctcttcatagaccgcttcaaactgatcatgtttttcataaatatcatcaaaataccggatgtccgcttccgtctcttgctctaattccggaatcaaagggtggtctttcgttcttatatataaatgcttcgcctgagtcagcagcttatgtatgcccactgtcaactgatccatgtctccggcgccgaggccgacgaccgtaatgttacctgccatgtttttctctcctctttttcaatttgcttaaagcactgccgaaaggaaggccgctcagctcttcgtccgtgaaaatcttcattcttatcatacaataaataaacaatagccctccgatgactgacgcagacagactctcacatacagctccggccctgctgacgggaacaaataactgccatagcttcatatatacgagcagaaagaagaccatcagcagactgcaccagcacagacgggcaatcacgccgccgatattcgtcagccagcccttcgaccaaattctccggagattcaggcacgcaactgcggcaaatgccaagacggtcgccagtgccgctcctctaataccccagccggggaccagccaaacattcagcacccatttcagcgcccctcccgccaaaacggatacggcggggaaaacggtatgtcccgctccttgcagaatcgcggctgctgtaagcgcaatcgaggcaaaaaagatagataagctgaatatttgtaaggtctgcgtcccctcactgttttggaaaagcatgatattcaccggctctaaaatgcaaaaaagcccggctgatgcaccgatccctaccgcaaggcagagcttgacggctgatgtcgctttctcttttatgataaacggcttattctcatgcaccgcttttgaaattgaaggaaccaatgacgcggcgatactgacggcaaacacggttcccagctgaaggagcggctgtccgcggtcatatatgcctttcagctgtttcgcggcatggctctccgtcccgtctgaaagcagtgaatataagtttaaggcgtctacaagctgaatcaaaagcatgagtacactgctgatacagatggtgactgaataaagcagcagcttttttacaatgacggccgttgcgatatgtccgccgtctttcttggtttcttcccgcttataccagaaaacagccaatacacaaagggctgccaagcttccggcaattgatcccgaggccgcccccgcaccagcggcgtataatgaacggccgcttttcaaaagccagaaggataaaccgagaagcaccgccacgcgaagaagctgttccgtaatctgggataaggctgacggcatcatatcatgcacgccttggaaatacccccggaaaaccgccgtaaacggaaacagtatgaaagcgaacgccgcgacccttatcagcatcacaaggcgggcgtcacccataaaaccggccaacggcgccgcgccgacatacatgagcgcaaacagaacaagtccggccgccgtgacataaagggcggaaattttcagtattttttgtttctgatcgctataatcgttcattaattttgagatgataaccggaaaaccggatgttgacagcatgaccgcgatccctaaaaacggatacacctgctgataaatgtaaaatccgacgtcaccgacaatattctgaaaaggaaccctgtacacggcgcttaatatcttcgttacgatacccgcaacgacgagcacaaaagcacctttccatgccgattgccgcttggcgccaactgaatcgttcatccaaaagctccttccagccgctagaaaatcacgtctataaaacgagcttattatatcacaatcctaacggccgaaccgatagagagcacatatgaatatgaaaaagaacagcacttgtataagagctgctctttctccgttttcttatttcaataatggtaataagacctactgctccatttgtctcgccaaaaaactggctgccgtttctaccgctttatgttctacttctccaagtgcctgttccttggaaaagatgaccacggcaccgataggatcgccatttgccacgatcggagctattgtataggagctcatatcttcatcaatgtcattaacaagctgcgcggacttcacgtcgttttctaccactgagctgcgctgatccatcgttttttcgagcaaatcgctgatggctttgttcagaaattcttttttcgaactgcctgaaacggcaatatacgcgtcacggtcgcaaatcaagacggaatggccgagactgtcatacaaagcatctgcatattccttcgcaaaatcgccaagctcactgataggagaatactttttcaatataacttctccgtcgcggtcaacgaatatttcaagcgggtctccttccctgattcgcagagttctccgaatttctttaggaatgacgacccgtcctagatcatcaatacgacgtacgatacctgtagctttcatctctctggtgcctctctttcatgtgatgatatttaagggaaagtactaaagctctttactttatgtagcttccgccactcgcttgaaattagtatccgtcacatcaaatgtaatatacaccagagagtaacaatttttatgaagacgcgattgtttctttcttcacatcctgaaggcctttcagcatgccgagcacggtctccagccactcttccgttttgcggcctttcgtctgtactgagattttcagctttttcccttccattcccagtccgatctgccggccgtatttattgccgagttcgaacaatttctgaccgtcaatctgtgcgctggcctcttcagaaatggtaaatctgatcgcgtctttatcctgcttgatgagttcgacgcgttcatattttccgtataccttcatctcagcaaccgtaaacagccattcaacctctttaggatagctgccgaacctgtcgatgatttcatcttgaagctcatttttctcctcaattgtggcgattgacctgaagcgtttgtacatgtcgattttttgcttgccgtcttgtatatagttttcaggaatatacgcgtcaagctcgatatcaatttctgtctcaaactgttcgcttttcggaatatcgcctttccgctcttcaatcgcttccttgagcatttgcgagtacaggtcaaaaccgactgagtcgataaagccgtgctgctgggcgccgagaaggttccccgctcccctgatcgtcaagtcacgcatggcgattttaaagcctgatcccagctcggtaaattctttaatcgcctgcagccgtttttccgccacctcagtgagcactttgtctctgcggtacgtaaaatacgcgtaagcgacgcggttggaacggccgacccgtcctctcagctgatacagctgagacagccccattttgtctccgtcgaacacaatcaaggtattgacatttggtatatctacgcctgtctcaataatagtcgtgctgacaaggacgtctgattccccttccagaaaattgagcatgacgctttccaattcattttcggtcatttttccgtgggcatatgccactttcgcatcgggaacaagcatggaaatttcatcagccttccgctcgatgtcatccacgcggttgtacaagaaatatacctgtcctccgcgcgccagttctctttcgatggcttcccgcacaagcgcgccgttgtattccacgacatatgtctgaacagggaaacggttttccggcggcgtttcaataacagataagtcccgcacaccgagcatggacatatgaagcgtgcgcggtatcggcgtcgctgtaagagtcagcacatcgacattggctttgatctgtttgattttttccttatgcgttacgccgaagcgctgctcttcatcaatgatgagcaagccgagatctttatagacgacgtctttagataagagcctgtgggttccgattacgatgtctaccgttccgtttttcaggcctttaatcgtttcattggattcttttctcgttctgaatcggctgagaagaccgatgttaatcggatagtcctggaaacgctccataatggtttcataatgctgctgcgcgagtattgtcgtcggcacaagaagcgcgacctgctttccgtcggcgatcgctttaaaggccgctcggatggctacctccgtcttcccgtaacccacatcaccgcaaagcaaacggtccatcgggcgctctctttccatatcctttttaatctcctgaatggaacggagctggtcctctgtttcctgataagggaaagcagattcgaactgccgctgcatttcatgatccggcgagaacgcatagcccttgcttgcttcccgttccgcataaagcttaatcagatcatcggcaatatcctgaacggagttttcaacttttttcttcacccgtttccattcactgccgcccagtttataaagcttcggttcttttccttcagagccgacgtacttctgcacctggtcgatttgttctacagggacgtacagcttatcgctgccctgataatgaatgttgaggtaatctttatgaatgcctttgatttctagtgtttcgatccccaaatacttaccgatcccgtggttgacgtggacgacatagtcaccgacctgaagctcggaatagcttttgatccgttcggcatttgtcagcttctgctttctcggctttttcttgattcggtttttgaacagctcttcctccgtaatgacggccagcttcatcagcggcagttcaaaaccggattgcagctcgccttccatgacatagacctgtccttgcacaagcgctttggagctgtccgtttttgcggcttcaatttcgtaatcagccagcacggatgccaatctgtcggttctgtccttatttgcgcctaaaaagacgacggtgaagtttgatttcttaaagcgctccatttcacctgcgagcacattcatctgcccgtgaaaactctgcatctgccggcttgtcacattcacgatattctgagggcttgtatgctggacatgacgcaaaaataatgaataataaatagccgggcgccgcttttcgctcataagctcctgaaagctgaaggataaatgaatgtcatgcagaattttcccttcctcgagcagacttgtcataaattcggcctcttctttttgcagctgatcctccatttcatgaatgcggctgacctcgtctaacagtaacaacgtgtctgccggtgtataatctagcaaactagcaggtttttcgtaaaagtacgagagatacttcacaagttcctgatcagtctgtcccgttgataaccgttctttatcatgtgagatattgatatgaagcatttccttttgtttgtcctgcttcagctttttcagactgtcggcaagccctttatcgagcctttccatcgcccgggctttttcttccgccctgatgatcaattccttcgccggtccgatcgccacatgtttgagcgtctcaattgatctctggtcatcagaattgaagcttctgatggaatcgacctccgtatcaaacagttcaattcgcaccggatgctccgacgtcagcggataaatgtcgataattccgccgcgaatactgaattcaccgggtgcagaaaccatatcggaacgctcataccccacctctacaaggcgcgcggacagctgatccggttctatttcgtctccgagtgaaatgacgagctggctgcttttccacagctccttcggcggaagcattcttctcactgccgcaacgggcgccacaacgaccggcgcttctccgtttgttaatctattaatgacatcaagccgctgagcacgcagttcagggctcgctaccgcaatttctgaagaaatcaattcattcacggggtataaaaaaacagattgatccccgagaagcgccgtcagatcttccgtcactttttgggcctgatataaattatgggtgataaagaaaatcggccttttcgtttcctgtgcaagggcagaggtaaaaacagaacgcgcggaacctgacagacccgcaagcagctgttccttcagcccctcatgtaaaccgttgacaatggatttaaaatcatcgctttctttaataaaggtttgaatgttgtccatatgggccctcctctctattttctgcaagaacagaaaaacgctttggtctagaatctacaccaaagcttcttattgaataaatgtgttgtgttcatggtagtgcggattgcgctccagcgcctcttggcagtcttcacaaattgtaagaacatggacatctccattgtctttatatgaaatcatatcgtttctttcctcatttgttaagtgctgaaatccaagtgactgtgtcggcaccgtcgaatattccaggctccctaccttaaagccgcagtggcggcagaaataatgcaaagccatacgttggacctcctgatgtgaaaaaatcatttttccctagtatggtctcccattatttatcttatacatttgcattaaattcgttcatgacttctaaaaatggtttcgttaaggaagcttcgcaggcttttacggtttttgtgacggcatcattgatatgcggcgcttcttccttcgtaaaagctcccagtacatagtcaacgactttcattccgttgacggggcggccgattccgattctgacccggtcaaattcaggggttccgaggtgctgtataagcgatttaattccgttatgtccgcctgcgctccccttcgtccggagcctgatttttcccgtcggaagatcaaggtcatcgtatatgactttcagatcttcatgatcggcatcataataatccagtagcggccgcaaacattcccctgataaattcatatatgtaagcggtttaacaagtagaactttttttccggaaacaaacccgattccgtaaagtccgttgaatttcgttttattcaattcaatattccattctttagaaagctcgtcaatggccataaagccgacattatgtctcgtgttctcataggttttcccggggttaccgagaccggcaatcacaagcatcgtaaatcctccctcaacatcgctgtaattcttctcattctagcacaaaagacgtaacctcgggcgggttacgtcttaaagcgcttattgattttctccttcgggctcttccccaggagacggttctgcatcttcttcgaatgcttcctgcttaggaggaaggatggaagccacgacttcttccggatcgtttgtaaatgtataattgccgtcagcagtcagatttgcgatggtcagcacatcattcatttcaagcccggaaatatcaacattgattgtctgagggatgtccttcggcttagccttaatcgaaagctcatgcagcggctgctggatgacgcctccgtctttgactcccttcgcctctcccgtcagctgaatcggcacctcggcctccagctcctcactcatattcacgacttgaaaatcggcgtgcgtcaattcgtttttgagcgggtctgtctgaagatcagtcaccataaccgattgctgatttccgttgacatcaattgtgataatcgtgttttttccttcgtcccgcaatgttttaagcaattcaacactgtctaaagagacaggcgtgttcgttatttctttaccgtatataatccctggaacatgtcctgaatgacggattttccgaagcgtcgaacgtttaaaatctgttctttcatttgcttttaaagttgccatattcagcaccatcctaattatcgttttatcgtcctattagaacaatacccacaataactgggatttaaaccttaaagtttcggtttagctgaataaatagctgacagattgtttctcgtgaacgcggataatcgcttcagccagaagcggtccgacagaaagctgcttaaagcgttcgatttttttctcatcaggaagcttaatgctgttcgttacgacaagctccttgattttagagttattgatccgctcaacggcaggacctgacagtacagggtgcgtacagcatgcatacacttctgcagctccgttttcaaccagcgcgttagcggcaagtgtgattgtgccggccgtatcaataatatcatcgatcagaatcgctgttttaccttccacgttaccgacgatgttcatcacttctacctcattcggtctaggacggcgtttgtcgataatcgcgatcggcgctttcagacggtccgcaagtttgcgggcgcgcgtcacaccgccgtggtcaggagaaacaatgacgatatctttcaagtctttaccttcaaagtaatggcctaaaatcggaacacccattaagtggtcaatcggaatatcaaagaaaccttgaatttgcggcgcgtgtaaatcaagcgcgatcacgcgtgtcgcacccgctgtttcaagcaggtttgcaaaaagttttgccgtaatcggttcacgtgatcttgcttttctgtcctggcgcgcataaccgtagtacggaatgacaatgttgattgttttcgcggaagcgcgctttaaagcgtcaaccataatcagcaattccatgatgtgctcgttgaccggcgcacttgtagactgaatgatatagcaatcacagccgcgaatactttcttctatgttgatctggacctctccgtcactgaatcttgtaacagagcactttcctaattgaacccctacattatccgcgatttcttttgcaagttctggatttgaattcaaagaaaaaatctttaaattcttatctccgtattcgttagacatggtaaacctccgattttaggattattttttatgaatgtttttcacataatcttctttatttacttgtcttgctctggcaatggcaagcgcttcgcccggcacatcttcagttacggttgaacccgcagcgacgtacgcgccttctcccactgtaacaggagcgaccagattggagttgcagccaataaaggcgccgtcttcaattttggttaaatactttttcttcccatcataattgaccgtgatggagccgcagcccagattcacatccgtgcccacttcggcatcaccgatatagcttaaatgagatgctttgcttcggtcgccgaattgtgttttcttgatttcaacaaagtttccgatcttcacttcattgccgattgcggaatcgggtctgatgtgagcaaaaggaccgatatttacatcattcccaactttgctgcgattgacaacggattgtttaatcacagtgcggctgccgattgagctgtcctctatctcagtgtgggggccgatgacacattcatcgccgatttcagcttgtccctttaacacagttccgggataaataactgtatcttgtccgatacgtgcgtcaggtgagatgtacgtattcatcggatcgattaaagtgactccgttctgcatatgccgtttgttaatacgctctttcatatacatttcagcctgagaaagagcgactctatcattcactccgagcgtctcttggaagttaccagtctggtaagcggcaacagtttcgccttcgtctttgaggatttcgatcacatccggcagataatactcgccttgggcattttcattcgaaacctgttcgatgacacgaaaaagagcctcgttatcaaaacagtacgttcccgtgttaatttctttcacaagacgttcttgctccgaagcatccttgtgctccacgattttttgaacggcgccgtcttcactgcggatgattcttccgtatccggcgggatcgtcggcaacggccgttaacaccgtggcttttgcacctttgtctgtatgttcattcagcatggcttccatcgtctccgccgtcagaagcggtgtatcgccgcaaataacgatcgtgacacccttttctccgtgaagaaatggttttgcctgtttgaccgcatgagccgtaccgagctgttctgcttggagagcgtaatcgcttttctgtccgagctgcttcttcacatcttcggcgccgtgtcctacgatggtgacaagcttcgctaaagataatttcagagcttcgtctgcgacgtgctctaccataggctttccgcataccggatgaaggaccttgtaaagcttcgatttcattctcgttccttttccggcagctaaaatcactgcaaaccgcttatccatttaatggcctccaatatcccttttatccatagaaaaatatatcctaaatagctgttgatttcaagaagacatcaaaaagtgcaagaattttctatgtaatcgctttattactgaaaaatcagatttaaaaaaggactgccggaaaaggccttgtgtcagcctttatcagcagtccttacattttgttatgtttaagaagccccggcttcttcatattctaatgcttcagaatcacccaaacgatgatactcatttaaaacagcatcctggatcttgccccgcgtgctggaattaataggatgagcaatatcgcggaattctccatcaggggtgcgtttactcggcatcgcaacgaaaagaccattgtttccatcaatcacacgaatatcatgtacgacaaattcgtgatccagcgtgatggatgcaatcgctctcatgcgaccatcggtattcacgcggcgtaatcttacgtcagtaacttccacagtagttcaccaccttttccctatataaaagcattagtctaacaattccacgattctttttaaattcctgcacgtttcaaaaagtttttttgaaaatataggatatacatacacaattaggtgataaaccatatttggggatcatatactgcataaaaaaagtgatcccggagaccggaaccacttttctgagatttaagatttcaccagcgcaatgacttcaatttccacgagagcgtctttcggcagtctcgccacttccacacaagaccttgccggcttatgtacatcaaagtattgtccgtacacttcattcacttccgcaaactgctccatatcagcaataaacaccgttgctttgacaaccgtctcgagagaagcgcccgcttctttcagcacagcttttaaattgctgaacacctgatgcgtttgttctgtgatatcaccgtttaccatttctccttcagcagtaagaggaatctggcctgagctgtaaaacatgttgtttacgatgattccctgtgaatatggcccgatcgctgccggcgcgtgttttgtatggattgcttttgtcatttttctgtctccccattctttaaatgctgttctttaaaaaatcgcagaaaattgccgttttgaatctcaatcgttttgtctttcatattgatggttgaaagcgtgagcagtgacatgtattcatcgacaagccgttcgttcactccctcggcttcaaccaagacgcctattcccgcaacgtttgcattaaactcatcaagcaggctgatcatgccgttaatggtgccgccggctttcataaaatcgtcaataatcaaaacgttcgaacccgtagccaaacttcttttcgcaagcgacatcgtttgaatgcggttagatgaccctgatacataattgatgctcaccgtggagccttccgtcaccttattgtcttttcgcacgatgacaaccggaacgttcagataactggccgctgcgtaagcaagagggattccttttgtcgcaacggtcatcaccacatcaatctcccgctccgcaaaaacggaagcaaaaagcctgcctacatgagagaggacagatggttttcctaagatatccgttaaatatacataaccgcccggaaggatacgctcaggatttactaaagactgtcccagctcctgtataaacgcttctgcttcagcctgtttcactttcggaatgtatttgacgcctccggcagctcccggcactgtaagcagcgtcccaatgccttgctgttcaaaggtctgtttaataatcgttaaatcttcactgattgatgactttgctgattgataccgttctgagaaaaacgttaacggtattaattcatgcggatgggttaacaaataatttgttaagtccaccaatctgccgctgcgacgaaacttcatgaacttacccccaaaatccgaataatttaaaaataatataacttaacatacggatttaatcaagagcattctgttcgccgatcatccgcaccgcgtacacttgatcacagaaacctcttaacccgttataaatccgctgcaccttcgattcgtattgaaccaaaccgaatacagtcggtccgcttccgctcattaacaccgcatcagcgccgaagcgtttcatttgatttttaatcatcgccacctcgggatggaggctgagcgtaaccgactccaatacgtttcctaattgtccgcataccttttggaagcttttttcttcaatcgcgtcaatcatcgcctgcacatcgggatgccgaacctgctgtaagttcagccggcggtacacttcggcagtcgataccccgatcgtcggtttggcgagcacgacccagcaatgaggcggagcactgatgtgcctgatcttctcaccgcgtccggttgccagagcagtgcccccgtatacacagaaggacacgtctgaaccgatttcagctccaagctccgcgagctcttcgacagaaagctttaaatcccaaagcctgttcagccctctgagcgtggctgccgcatcgctgcttccgccggcaagccctgccgctacagggatcacttttgtaatcataatggaaacgccttttttgacttgaaatcgttctttaagcagtttggctgcctgataagccagattcctttgatcatccggaacaaagcgattatgcgacgccactctgataacgttttcgggcagttctgtcagttcaatccgatctgccaaatcaattgtcgtcatgatcatctccacttcgtgataaccatccgggcgtttactcgtcacatcgagggacagattgattttggccggcgctttttctaaaatacgcatagctttcacctacttctccatctaaacataagtatgaacattgtatcacatttggagacccggaggtacttatccgaaattgaagccggttttgacagccgatagaaaaaaccggggaacggattgtcccccgggccactgcattatcggttattttggttctgagccgccatctgctgttcggcaatctcaatcgcgcgctttaccatattcccggcgtcacgcgcccgaatgcctccccagccctcgtttttcaccgtatcgtaaaaaccaaggtccttcgccagctcatatttgaactcatctgacataactccacgacgtctgcccaaacgaaacaaccccttttatagaattgatcaccattcgtgcacgccacgataaaacatgtgacacttatagcttccgtttaatcggctgaaactttcgagggaataattagaagagctttagaaggcaaaacaaaaagcagtaaacaaaaggttcactgcccattaaaatgctactgagcttgccgcatcgtcattgaatgtcaattcaacagtctcagtcagaatatcagcataactgtatgaaactctttcaaacgaattctcgtcttgatctagttgtatcacaaaaacagaagggtacgtctcagctaaaatgcccgaacgctcaatcgtttttcggcggccgccgtttgcttttaacgtaagccgtttacctaaattcccatcaagcgatctttttatatcggacaacgtcttcgccattgcatccacctcactacatttattgtacaacaagagcccaattttgtcaaataaaatttaaattatatcaacgttaataagtcattgtcaacaaaattattttgacaaaattctattgatttctgcgttatttttcacaagttccggaaatttatgtatcaatttgtaaaataattaacccgcatagcgaaatatatgcgggttttatcactcatccatttgatttatacggcataccgacacgcagcacacccttcgtttcaattcctcccagccctttctctctcgtcagcgtatttctcaggacatcccacacattgatccgctccataaacggagtgaagctgattttcgcgacaatatataccgggtcaagcgcatgaatattgacgcgtgacggcgaacttgcgaaattcgcgcccgctctgattaaagactcgaaatgagattggcaggcccccgcgaatatgaccagctgatccaaatgagggactttacgcctcgctctttgaacggtttcgacaaagtgtttggaatgcctgtaggcgcttaaatcgttcacgcctcccttatgcttggaatatgcatcatggccggtgatgactaaaatatccggcctgtatttatcaagcagctcgtcaattgatgccggcatttttttctcatggcaatgaattccgtataccggcacaccgattttttcataaaagttcaggcactttttcaaataggcctcatcgccgtccagatgcaatacctttccgggcatatgaaagtagtgctcctgatgctgatattgatttgtcgcataatattcctgtttttcccgaagcagcttataatcctggcggagcagctcgagagattcattcatcctgctttcatctcttttctttctcatggcctgttcgtcttttctgacaggctccaaatcagaaaaatcagcatccgcaatcaatctgacttcgtcaccatgcaggatggcaattgaatttccgttgcttgtttgctctataccgataatgcgaaataaaacatccatttgataggatttcctggctaccatatctcctatttgaaattgcacgttacccactccacaaatagactaagcctcatcatgaaagaagtcttggcaaatacacctctttccgctgcggcgcttgatgtttcaagcttttcttgcagttgaatgaataaggttctcctctagcctatgtagcggcagtccaagtggtgacgcaaaacaaaaagccctcttagaaaagggctttatgcaatccgttggacaggagcgcgaattcttctatggacagggattcaccgcgccgctttccgtcaatattcgtttcttgaagaacttcttcaatttgagcttttttctcttttccgcccggaagattgttcacaaggttgttaagcaaggttttccggcgctgtgcgaagcttgctttaatcagctggaagaaaaacggttcattatcgacgtcaaccgccgggccgtcacgaagcaagagacggatgacggcagaatcaacattaggctgaggcacaaacaccgttttcgggacggtcatgacggttttggcctccgtatagaattgaaccgcaatggaaagcgatccgtactccttagaagaaggatcagcggccatccgctcagcgacctctttttgcagcatcacgacaatcccttttaacggaagatgttcttccaagagcttcatgatgatcggcgtcgtcacataatatgggagattcgccgtcaccataatttcatcacaatcctgaaaatgctcttcaatgacggatttgacgtctgctttcagcacatcttgatgaatgatcgttacattgtcatatggagacagcgtatcattgagaatgggcaggaggcgctgatcaatttcaaacgcgacgacctttttcgcccgtttggcaagctgctctgtcagcgcgccgattccgggcccgatttcaatgactccggtccgatccgtaatttccgcatggtccacaattctgtccaatatatttgtatcaattaagaaattctgtcccagactctttttaaaagagaaaccgtactttttcagaatttccttcgttctgataggtgtcgcgatatctttattgttcatcctgttcctcctgcctcatagcatcgagcgcatcaataaaatcacttcttttgatttgaaacatttgcagccgtttttgaagctgcttgccgtttgtatagccgatcttcagcaggtcgcccaatcgttcgcggcgtcttttggcagccggtccgccgatcagaccggcctgtatgacatcttcagctgaaatctcactcggctttgcctccatctcttcatgcacattttccagacatgctctgatgctttcaatggatgcgtgctcaacgccaatgccgcgcttgtttttcggtttggcaagatgtttgggcagaaatgcgtgtttacagccgggtactgcttcagaaatggttttccggatcttttcccccggaaaatccgggtccgtcagcacgatgacccctctcgtttcctgcgccagccgaatctgtctgatgacttcgtctccgattgcggaaccgtttgtctcgatcgtatccgcatcaacggcaagttttatgcgcgcagtgtcatcgcgtccctcgactacaataatttctttaattttcattacttcctccaaaaaaactttttatatccaaaacgaaacctttgcttacatgtcacgtctaatatactgaaaatacactttacctattataacgaaaaaaacagagggcgcaaaaccctctgagtgaatcggaattaatttaagatttttattttgacctgtttctttccccagcggtaagccgaagatttttcagggaaaaagacatcaatccgtcttcctttaatggctgagcctgtatcagcggccacggcatccccgtatccgtctacgtggactcttgtgccgagcggaatgacgcttgggtctaccgcaatgactttagcattcggattgcttgtcaggttaacgcctgtagccgtatggccggaacagccgctgcagcttgcggtataagccgtggaagacacggtaatcactttaccggaagatccggtttcgccagaagatgccttcacaggtgcactgagctgctcaatcttgggactgtgccgctttgtgccgaccgcaatgatttgatctttgcttttttcagatgtttcttctttaacaagctttcttgaaacttcttttccattttctttgacaacatgaaaatgctttttaagtttgccttcttttcctttttgaacgatcttttctttcccgctgtcgagagacgcatcttctttttctttcacttgatacgctattttttcctcaactacatcggtgactttttcgatacgagtgatttgtatgccggcctgattttttgtgagcttttcgtgtaatgccggttttactttatcttcgtctttcatgtccatcttatgctgcgttaaaaagtcagcgaccgtagtcgaagtcgtccatattttctttttctttcccgcatcatttacagtgacctgaaaagccgggtcgaccgtgactttcatgccgtttgtcactttcgtatctgctgctggatctattttatcgtgctgattcacaggtgtatgctgttcgttcagaaatgcgccgactgtttttgccgttgaccataaagtcttttcttctccgcctcttgtcacacggatctgctttgcagcttcatacacgacattcatgttgtctgccaatgctgtctgcttagacggggtaatccggtcttcatttctcgtctctatatgtaaatcttccagaagttccccaaccgtttttgcatgagtgcgtatttgctttttcttgccgttgatagaaacagaaactgattgttttgagagctcatgtgccccgtatgcagtcccggttccgcccagcagaataatagctgcaataagaataaccttgcttttaccaagctttacggaaaacagttttttcattttttgtgtgatgaaaaacgcctccttctcctcggagagattatatagagtatctaaaatgctgtcaaccctcccatctcgaagatgaaaaaccttcagcgtatccctcattatgcaaaaacaaagcaaaaaaaggaagagagacatatcgacaacctatcttatgaggagaaggaagcttgtagaaccgttttacatatccactgaatcggacaagcctttacacgttacgacagcgcattctgtcagttcatgcggaaaagtctttttgcgttttcggttgtaattgaggcaatttcttcatatgtcagcccttttaattcagcgagctgttcagcaacatattttacgtagcttggctcatttcgtttaccgcggaaaggatgcggtgtcaggaaaggacagtccgtttcaatcagcaaacggtcattcggaatttcctttgctacttcttttggtttcttcgcatttttgaaggtaaccggtccgccgaatgaaatataaaaattcatatcgatacactgccgcgcaacctccgcgctccctgtaaagcagtgcataataccgccgacttcttccgccccctcttctttcaaaatcgtgacaacatcttccgttgcatcacgattatgaatgataattggaaggttcacttctttggcgagagcgatttgtttccggaatacttctttctgaatgtcttttggtgatttatcccagtggtaatcaaggcccatctctccgattgccacaactttttcgtgagaggacagttccttaatccatgataaatcttcctctgtcatgtcaattgcgtctaccggatgccagccgatcgcagcgtatataaagtcatattcctcaatcagctccatcgcacgcgtgatagtgggtttgtcgaatccgacaacgacgatccgttcaactttttcagcctttgcacgcgcaatgacttcctctaagtctgtgtcaaattgctcggcatttaagtgcgcatgtgtatcaaaaagcatcataaaaactcctttcttgttgaaaaacaaaaggtgttcgacggaatgttacacgtgaaacaccttttgcatctattatttaattcgagtgcctttcggtaatgactggtcgacagctacaactttgagaacgccgtccgattctcctgccagtatcattccttgagaaagctcgcctctcagttttaccggttttagattcgttacacaaatgatcttcattcccacaagctgatccggtgtgtaatgcttcgcgatacctgatacaacttggcgctgttcaaagcccagatcaatttgcaatttcagcagccgatctgcttttttcaccggctctgcggacaagacttctgcgacgcgaagttctgtatccataaattgatcaaacgtaatttcaggaagacgttctgcttcttgcggctcttccgccttttcttctttagcaggagcagttccttgcattttttgcttgatgtaagctacttcttcttcagcttcaagacgagggaaaagcggttccccttttttcactttcgcgttcttcaattggccgaatgtctgaatgctgtcccatgctttaagagactgatcctcaactccgagctgggcaaacattttttcaggcgtttgtgtcaagaaaggctggagcaatacggctgagatacgtaaagattcagctaaatgatacatgacggaacataattctttttctttttcctggtctttagcaagcacccacggagcagtttcatcaatatatttgttcgtacggctgattaattgccatagcgttgataaagcgactgaaaactccatgttttccattgccttttcataagctttaaccgtttcaccggctacagaagaaagctctgaatcaaaatcggtcacatttccttcatatgaaccaatctcaccgtcaaaatatttttggatcatcgcgactgtacgattcagaaggtttcctaagtcgttcgccaagtcataattaatccgttctacgaaaccttccggcgtaaagacaccgtctgaaccgaacggtacttcgcgaagcaggtaatagcgaagctcatccaagccgtagcgttcaattaacgttaccggatcaacgacatttccttttgatttcgacatttttccgtctttcatcaataaccagccatgcgcgaatacttgcttaggcagcgggagatcaagcgccatcagcataatcggccagtaaatggtatgaaaacggacaatttctttaccgacaaggtggacgtcagccggccagtactttttgtaaagctcatcattttccgtatcgtaaccgagcgctgtaatatagttgaacagtgcgtcaatccatacatacacgacatgcttcggatttcccggcacttttacgccccagtcgaacgtcgttctggaaacggccaagtcttcaagccccggtttaatgaagttgttaatcatttcatttttgcgtgattcaggctggatgaaagaaggattttcctcataaaacttcagcaggcggtctgcgtatttgctcatgcggaagaagtatgactcctctttgattaattcgaccggatggccgctgtccgggctttttccgccgacaacctcacccttctcatttcgttccacatccaccagctgtgtttccgtatagaatgtttcatcagggatgctgtaccagccctcatactcatccaggtaaatgtcaccattatcaagaagtttttgaaacactttctcgataatttctttgtgccggctttccgtcgtccggatgaaatcatcgtgagaaatgtcgagctgcttccatagtttttggatttcagcaactgcacgatccacataagcttgaggcgtgatattctcttcctccgctttctgctggattttctgtccgtgctcatccgttccggttaagtagcgtacgtcaaatccttttaatcttttgtaacgcgccatcgcatcgccggccacggtagtataagcatggccgatatgtaattttccgctcggataatatatcggggttgtaatataaaaagtattattgtcttgcggcatgttgcaacctcccattcagaatgtcgaaaagctcacgcccaaaggacgagagcggttttatttgatatacaatattgatatttgtcctctatctatgataccatcttagcctttaagatcaaggatatatacgtactgcgcgtaaaagagtaaataaaattaaaaatttttattgaaattaaaaaaagtcttaacatgtcgaaatttgtcgtatataatctactaatataaaacatcttggttcgaaagtcttgatttaaaaggattttcagtaggataataggttcgaaaaagcagtcaaaaagcctgttatttcaggatttccaaggctttacttactataagaactaattcttacaatcaatagtaaacaaaaagattgacgattattggaaaccttgttatgctaggaatgtaaggaattttgtcgaataatgacgaagaaaaatataaactacaaaataattatctctcgggaggagactgttaatgaaatctactggtatcgtacgtaaagttgatgaacttggacgcgtcgttatccctatcgaacttcgccgtacactgggcatcgcagaaaaagacgctcttgaaatttatgttgatgatgaaaaaatcatccttaaaaaatataaaccaaacatgacttgccaagtaactggtgaagtttctgatgataaccttaaacttgccggcggcaaattggtactcagcaaagaaggcgctgagcaaatcatctctgaaattcaaaaccagcttcaaaaccaaaaataagctatttcatacaaaaaccgttcttgttacgatacaagaacggttttttttatgattgaatgtgataagcgtcataaatctctcgtttcggtacgccccgatctaccgctgtttgttttatggcctgtttggaagatgctccttcgtttatgtaatgctccacatgctctttctcagaaagctccgtccaccaaggcttttcctcttcatccggttcagcggtttgatttccttcgacaacgagacagaactcaccgcggatttgatcttcatttgcccattccatcacctcggcgatggttcctctgatgaattcctcgtactttttcgttaattctctcgtgacggcgatggttcgattacccaaaacgtcatgcattgctattaatgtttcttttaatctgtgcggcgcttcgtaaaatatcatcgtttcctgccgttttttcaggatttcgagttctttcttcttttcttttttctgtctgtttaaaaatccgtagaagaaaaacggctgcggggtgatgcctgatgcggtcagcgcggttaatgccgcattagcacccgggagcggaacgacatatccgccgatttgggtgaaatctctcacaatctcagcccccgggtcggaaattgtcggcatgccggcatcactgaccaatgccacattctttccgcttttcagccattcaatgattttatggccgctgctttctttattatgttcatgatagctgatgagagatgtttctatgtcataaacatggcacagctttttcgtctgtctcgtatcttcggcagctatgacatcggccgatttcagcgtctctactgcacgaaaggtcatgtcctccaaattgccgatcggtgtaggaacaaggtacagagttcccatttcagattttccgttaaaactcatctggcgtcttaacatatacagcctccttgctgcgtcgtttttcttctatatattgctcttttttctttcgggtcagctgcttaaaacggtattccgcctgcatcgcttcccgttttgtttcaaatgattccgcatggcataacgaaaccggcctacgcgcccttgtgtacttcgcgccctttccctcattgtgggttttcagccgtttttgcagatcatttgtataaccggcatacagactgttgtcattgcacagcagcacataaaagaaatgactatttgtctccatataaaatcgtgcggatctctttcgtatattcattttgttcattgtatacgaacagcgggggaagaattttgagatcagggcggccgcctttaattccttcaaccaaaatggtattcgcttctttaccttgtttcggataaataaactgaacccgtttcggttctattcggtacgctttcattaattcaaagatttccaaaagcctccccggccgatgaacgagagccgcttttccgccttgcttcagcagtttgctgctgacggaaatcacatcttcaagcgtgcaaagaatttcgtgccttgcgattctgagatgctcgttcaggttctgctccgcctctttcggtgttttaaaataaggcggattgcaggtgacaatatcatatttattatgtccgagtctttccggcatatttttcagatcatcatgaatgagactgatctgaccgcccagcccgttgtattccacgcttcggagcgccatatcatacaagcgttcctgaatttcaaccccggtgatatcagcttttgaccttgtgctgagcaaaagcggcacaatgccgttccccgtgcataaatcaacgatgttccccttttgaatcggaacgtatgcaaacttagacagcagcacggcatctaatgaaaaagcgaaaaccgtcggactctgtactattttcatatcctctgctaataagtaatccaatctttcatcatcacgtaatgaaaccataatcttattcctttcggcactctttgaaaaaggcttccgacatcagcggaagccttttccttattttttatttaagaaggacagacaaaaaaggcaatctcccttgcggacgctcccataatggacgttgcaaatatgaaagccttcttgatacagccgggccagattgtcgtacccttctcctatatcactctgctctgccttctgtgtttttgtttctttctgatcggctttgaatttctcaatttgctctgtcgtatcatcaagccgcttacgcaaatgcttattttcaagctgaagatggtgattctcttcaatcatttcgccgatatgctgctttaagtcacccagctgacggtacagcgaaccgatttgttcctccaggtttatgacagtatcaaataactcttttttatccaaggttccacacctcgttaatctgtggtttgtgcggatacgacgccctcttccaagagctcttcccaagtatattctatcactttttcacgattcttcagttccacctgaagcacccgttccagaatattaagaccgacaacctttgcggggccgtttgccgtcgtaatcatttcgcctaaatccggcagctgttcttttgccgtctcatactcatcattttcgtacttcaaacagcacatcaaacggccgcacagaccggaaatcttcgttgggttcaacgataaattttgatccttcgccattttgatggacaccggttcaaaatcaccgaggaacgtggagcagcaaagcattctcccgcatggtccgataccgccgagcattttcgcctcgtccctcaccccgatttggcgcaattcgattctcgttttaaagatagaagccaagtctttgaccaattccctgaaatcaacccgtccgtctgctgtaaagtaaaaaatgactttattgcggtcaaatgtaaactcaacatcaaccagcttcatatctaagccgtggtcagccacttttttctgacagacttcaaaagcggacagggcctcctgtttgttttcttctacaatgagaagatcgcgttcatcagcaacgcgtatgacctttcgaagcggaagcacaacatcatgctcgtccacttgtttatttgcgatgacaacctgcccgtattcgacacctcttacggtttcaacaatgacgcagctgtcttgttctatatcaaatccgttcggatcaaaataataaattttccccgcttttttaaagcggacgcctattacgttgtacaagcttatccctcctgcaacgttaacaccaagtgctccattaatccctgcacattcacattggaatgaagccgtttttttgcttctaaaacagcgagaatttggttcgtaacgctttgttgtataaattgcagcgcatgctgttttattgattggaataagtcttgataaatcagtttatcttcatttccaatttggatggataatacatcacggtatatcaataagagcatatcaagacccatttcttgatgggttttttctttgaaaaagggcacccactgatcctgaatgaagaaaaaggcatgtcctttccgctgatgtaagacttcatacaattttatcactttcgctctggactctgcaaactcatcatttcgacttaattcgactgcttccgcaatattatttgtcatatttgctaagagccgggccatgtgagggctcacttcctgttcaatcagtctttcttctatggctttcggctgaagcggctggaacgggagaacctgacatctcgaaacgatggtatccagtattcggtggagctgctcagtaataagaattgcgatggtgtcttgactcggctcctctaaaaatttcagcagactgtttgctgcatttgtcgtcatttgatccgcatgggatataatgtacagctttttatgcgattccagtcctgttttagaaaactcttcctgaagcgattggatctgagcctttttaatggataatccgtcgggctgaaccacatggaggtcgggatggtttccggattcaatacgcttacagttccggcactccccgcaaggctcagtcccgtcttcaaggcaaaaaaagctttttgcgagaagcagtgcggcatccaatttgcccgttccttttttgccttcaaacagatatgcgtgagaaagccttttcttttcaatgctgttatgcaaaagccgcatcactctgggctgctgcccggtcatttccttccatgatattgccattgtatcactctctatgtgtaaaggttaatcaataaaccttttatttctccgattcgatccagcaaatcaattgccggtttttcctgatctaacatttcttccgtcagctgaagcagtttttcatctatttctttcacaagccccagagtccggctgcttccgtacaggtcaaagcttttctccgtctcatgcgataacccgctgtctacggcctcttttacaaaacgttttaccaatcctttgaatttcgctaagtctttgaagtttctcgacttcgtcagccttttcccgaacgtttctatatccgttaagaacctgctcagctgatcaaatttcagcttgctgctttggctgtccattgaacttttaaatgttccggaaagctctgccgctttataagcaggctgctgctttttctcaataaatgtacgtaagtcagaatttattttcacgtcgtcaaatccttaaaattgatgaaattcatcgaccgggaggacaaagaccgtcgctccgccgacttccacttcgacgggatatggaacgtaggaatccgcattcccgcccatcggggataccggggcaatcatctgatcacgtttacagccattctctttaatgaggctgagcgctttatcgacacggatatcttccaccccgatcataaacgtcgtattgcctgatttaaggaatccgcctgttgtcgcaagcttcgtcaccctgaagttgtggtcggttaatactttcaaaagcctgttgctgtcctgatcctgcaccactgccactattagtttcattctctaggccccctttaggttggaaagaacattatcgttacattcattatagcaacttatgagaaacaggtcacaactgaatttttttcaatgcttcatttatcacttgaagtgcgtcctgaatgacgagttccttctttttcgatgcgtcgattgtatggaatctttccggaaaacgctgcattaccttttggtatccttcccgtactttcgtatgaaagtgcagggcctcaagatcgagacgattcttctctcttgaatcattcgacgtaatccgtttcaacccttcttccggctcaatagaaaaatagatggtgacatcaggcatcgtatcgccgattgcaaactggttgatagaaaggacttcatcaatgccgagccctctcgcatagccttggtaagccagcgaactgtcgatgaaacgatcgcacagcacaatgcggccttctttcaatgcaggctgcaccttttcgactaaatgctgtcttctcgccgcagcgtaaagcagcgcctccgttttggcatccatcagtgtattgtttttatttaagatcacttctctgatctgttccgcaatgtcgatgccgcccggttctcttgtcgctgtcaccgggagcccctctgccgacagaatctctttcatttcctgaagcacagtcgttttccctgcaccttcaggaccttcaaatgttataaataaaccgctcatgatttctcctcttctatatagacaagtaattgttccccgtttaacaagccttgaatatgcgcgtccatgccgattaaacgggaaagcttttgtacgatctcttctgttatccgttctccgtccatgatcagcggaattcccggcggataaggaataatgttgcccgcatgcaagcgcccggccgccttatttatatctgcaggctcttttgtaaacttccgcatctcattttgcgggtattcaagtgtcgatatggacggaaatgtccaattcacggcatccggcaatttatcgggcggtgtattctccagtttctgctgtatgtttcttacggttgcctgttctatcatccgccggccgcctatcggcagtacgagcaatacttggtactcgtcagccagctcggcaacaatgccttcactctccaaaatccgttgtaatgaatagccggaatgtccgagctttgaccgaagaattaattttaacgggtccgcccgcagcccatatccagaaggctcgattatttcaatagaagaaattgatgcgaaccttcgtttgattttctcaatgtgctccatatgaacgggaagtgtccctttttcagcaatatcctgcacataagcgcgcgccgtatctaaagatgccataatcgggtatgacgggctgctgctttgcaaactgcttacataataagttaatcgatctctgtcaattctggtgctgttcaaatgaaagtaagaccccatcgtcatagccggaagcgttttgtgagccgattgaacaacggcgtctgcccccatagccaatgatgaaggcgggaaaggctggcctaacacaaagtgagccccatgagcctcatccaccagtacaggaacgccgtatgaatgggctttgttaactgccgcagtcaaatcggcagcatgcccgtagtaagtcggattggtcagaacaagtcctttcgcgttcggatatgacgccagcgctttttcgatgactgaaagggatacatgtgccggcacatgcatgttttcatcgatttccggcgccaaataaaccggcttggctccggccaatgccgccgcatggaaaacagacttgtgacaattacgctggatcagaatgggttcacccggttcacaaacagctaaaatcatcgccagattgccggcggtcgttccattgacgagaaagaaactttcctgagagccgtaaaatctgctcaccaaatcctgcgcttccttaatgacccccgtcgggtgatgcaagtcatcaagacccgtgatctcagtcatatcaatagataaaagagattgatatacagatttggcttcatcaaaaaagacatctccattgtgatgtcccggaacatgaaaagaatacgtatttcggtgcgcatgcttcatcagcgctgtatataaaggtgtgtccatttttaaacaaatccttttcctgtctttcttattatatcgtgcctgcgagccaacttaaagctaagactttttgccatctagccgttatcccggccggacctcatatcaagcagcttcttttttaaatcgccttccatgataacaagctcctcctcggcacgcctgcgtttcatcctgccttcttcttgaatagacatgatttcttcaagtgtgctgactaagctttcctgcagttttttgagggtttctgcctcaacaagtccgcgctcattggctttcgcggtctcgactgtacttgttttcagaagttcagcgtttttcagcagcaattgatttgtcgtatccgccgccttctgctgcacatctgccgcactccgctgcctcataagcgtcagcgcgatggcgacttgattcttccataaaggaatagccgtaacaatggaggactgaattttctctgccagtgcctgattcgtgttttgaatcaggcggatttgcggcgcactctgaagcgtaatctgcctgctcagcagcagatcatgcaccctcttatccagacggtcggcaaactggcgaagatcattcacttcctgcgcggccatttgattgtgtttttgtaattcggcttttcttgccgcttcaggtatcagctttgttttcagctcatctgattttaattcccccgctgctatatacatagttaaatcagaaaagtattgtttattttgggcgtacagctgatctaacaatttattgtcactcaacagcacatttttagaatgttccagccttctgctgatacggtcaatctgcacacttgtcttttgatatttcgaaagcacttcctgcacggaaccggacacccttttaaacagcctggcgaaaaaccctttgttcttcatctgcagatcatcggggtttacctggtcaagcttaatcatcagatcagccaatatttgtcccatctctcctgcatcttttctttgcacgtgctctatcatcgtatgggaaaattccagaagattcgcctgcgcctgtgaaccaaacagaacaatgctttgcatgttcccagggtccagtttttcagcgagctgaagtgccgcttctcttttttcttccggcagcgtatctgcaagctttagaggagtctggtcattttgggcgcccatgctgtcgtcggaacggtctttggccatttccttcttcctttcttattttctcagtgaatgctttgccatatctaattcaaagtgcaggtcgtcgatgtcctccttcatcagttcatgaagatcctcttccagccttctggaaagccctgccagagtcatcctcgtctcactcaaggacattgataaatctttattttttcgcggctgtgaggagagcagagcatacttttccgtcagttccacaacagaatcaagcgtttgataatagaaacgctctgcctgataaaaacgcttcggctcctgctttgtgagcagatatattcgtcgggttatccgcagtatctctgcattctgcttcagcatttgtatacttttagagcgaaaaagcgccctgcgtaatcggatgattttaccctttgcttcctcaagattttccttgatataagcatattcttttcttgtcagccggtgtttttttaaaaagagacgcttcgcattccacaggccggccgcactgacagcggctccgccggctgccccgtataaaagcgaatacagaaaaggctgatgccctatcgtaaagaaggttatccccgctaatacaaaaactgtgctgccgcaaagcgtccatttcatatattgaataaacggtttcatacttgatcgactcctatttattcacttttatcagtattatctattacattccatgtctaaacaagttcctcttcttatcgtatcagttcttttataaaaagtgtaaaaactcctctgatttcaggcaaaaaaaaaacccttttcagggttaagaatataacgtcggtgtatgaaggcttttcagtttacgaacgaaaaattcataattcggatcagaggtcggagtggaaactactttcttctcacactctaaacatataaatttcgtataaatatggattcccctgctttttttggtttcacacacaatacatgtttcttcatggctggacgtttcattcattttgcccacctccgtatgaatagccttcccttaagctgttgattgtatacacaatttggacctttttgaagtttgcaattagtatatgggcgtttccgtatttcggtgtttgttttgtttttattcaaaaacaaaaaaggcagctcatgatgagctgcctttatcataatatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacacgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaagttccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagaacttcgtccatcgctcttgaagcgacttaattattgtaacatatcagtgtcgatgtcgtcaataactttttataatttcttttttaagaattcgtttcgtcatcagcgacgtatataagaataccacccttgatccaacatgtcaacaataatcgataaattaaatgatgaagcgtttaatgactatcaaagccgcgatgccgggaatccccagaatcccgctgatgcccgttgtaatcaggttaacagggatatgaataccgagactgcctccgaacaagttcacacccaccagcagaatcgcaccggcaataaacttaatcgcagtcacaccaatccatcttagcggttttgaagatactccccataaaaaaagcaaagcaaccagaccgacaatcaaaccgataatgaaaaaaggctccatgaatcttccccctcgcttgtttagtacaagcttatgagaagatcccggagaatagacctcttacttccatctgctcattttcaaattccgctgcttcgcttctttcaaataaaaaaagtacttagattcagcgactttcagctcaaacaatacctcagcggagggctcgagacttttctcgaccagactcttctgtctgttccattcttctttttgtttaaagagctgttctatcagcttctcatcaaactcttttcttaatgtatttctgcgaagaaaacccatgccttgccttttcctcccttacaattcacgtcttccttcaagagcttttgaaagagtgacctcatcagcatattccaaatcaccgccgacgggcagaccgtgggcaatacgggagagcttgatgcctgagggctttaacagccttgatatatacatcgctgttgcttccccttcaatattagggttggttgcgagaataacttctgtcacttgatcatcctgaagacgtttcagcagctccggaatcttaatatcctccgggccgatgccatccattggtgaaatcgcgccgtgaagaacatgatactggccgttatattccttcattttctccattgcgatcacatccttagggtcctgcacgacacaaataacagacttatcccttcttgtgtcctcacatatataacaagggtcttgatctgttatatgtccgcaaatcgagcaatatgtcagattccgcttcgcattgacaagcgccttagcaaaatccaatactgtgtcttctttcatacctagaacaaaaaaagccagacgaaccgctgttttcggtccgatccctggcaatttcataaagctgtcaatcagctttgatattggttcaggatactgcatgtttatttatccccctagaacaaacccggtatgttcattccttttgtaaattgtcccattgtttcattcgtcatgtcatccacttttttgagggcgtcgtttgtcgcagcaagaaccaggtcctgaagcatttcgatatcttccggatcaacgacttcttctttaatggcaatgtctacaacttctttttggccgttgacttttacagtcaccataccgccgcccgctgtgccttcaagcactttttcagcaagctcctcctgagccttcgccatatccttttgcattttttgcatttgtttcatcattttttgcatgtttcccattccgccacgcatattcaatcactctctttcatcttattagtcttttatttcgattaaatccgctccgacaagttttttcgcctctgcaatcagcggatcttcttcagccggttcgtttgatccttcactttcctgctggtgatcatttaaaaattcttctcttattttaccccattgtgcttccggaacgccaatcaaatccattcttttcccgagcattgattcgagaatctgttcaagattcgtacggactccgttattgtcttctgcaaccattttacaatggatttcgtatttaaatttaagtacaaatgccttttgagcagcagccaccggttcactgtcattcaacagagccgcatgagacaccttattctgctgtttcaggtgtgccagcagcttgccccagctgcttttaagctgttcaagttcaggtcttgtggcttccttcaatatctcatgaattcttccgaccggagctttgtaatggctttttccgcctttttgaggacgcggagcttctttcggagcgctttccatctgaaccttcacaccggaggttttcagcctttctacttcctgctcaagctgctgaatcttattcatcagcatgccgacctcaggggtgtctccggcggattgctgtgccgtctggcatattttcacgacagccacttcaaaaaagattcttgggtggttcgtccacttcatttcctgatggcttttattcaggatatcaatcatctcatataaagcgggggccggtatgtcaccgctcagattccgaaacgtttcatcgaccttcaccttctccaggactccttctaaaccgggagcggcctggtacaagagcatatccctaaaatagaaaatcatatcttcaatcagtttggccgcatctttcccttgctggagcaattcattcagtgtttccaatgcctcggaaacctgtttgcggtgaagagcagatgccagttttccaatatagtgctgagaaacggctccggtaatgagcaatgcatcatccaccgacagctcctcgccgctgaatgatacggcttgatcgagcaggctcagcgcgtccctcattcctccgtccgcagcactcgctatgatatcaagggctccttcttccaccttcagctgctctgcatcgacgattgtcttcattcgtccgacaattgctttggatgtaatccgtttgaagtcaaaacgctgacatctggagataatggttaaaggaatcttatgaggctcagtcgtagctaatatgaaaatgcaatgtgccggcggttcttccagcgttttcagaagcgcattgaatgcgccgatagagagcatatgcacctcatctataatatatactttgtaggtgacggccgacggggcgaattttactttgtcacggatgtcgcggatttcgtctacgccgttattcgacgccgcatctatttcaatcacatctgatatagagccgtttgtgatccccttgcacgccgcacattcattgcacggttcttctacgggggcgtgctcacagttgactgctttcgcaaatattttagctgcactggtttttcccgttccccgcggtccagaaaacagatatgcatgagaaaatttcttttgcaaaagggcattttgcagcgttttcgtaatgtgttcctgtccgaccacatcttcaaactgctgaggcctaaatactcgatataaagcttggtaacccacaggatgcgccctcctctgttattcatcatgtttattatacatgaacgtgcttttaacgccaaaacccgtttttcatatacgaaaaaactcacctgccataaacaggtgagtctgaaatttgatgattgatttaccgtgcaccttctgtcgattcgctaccctaagcgttacttaagcagttagctcagcccaggcaaccctgcggcacatgagaggtttcacttaatgctgcttccttccggacctgacatggttcatgaattcccattgcgcaggacccagacgtcaacgccacttacttaaggcagaccttacagtaaacgaacctcgagaagggattcggccccgctagagcggattgcgggtacagggcaccgctacctccccgcttagcacggcaaaataaatatcaaatttttatatgcgcaccattcatgatgcacacataagtatatctgcttcaggcagaaaatgcaaccgtactactcagacaactttttcctcatgtctttcttttgccggcgcagctttctgaaaaaagcgctgagcatttctccgcactcttctccgagcacgccgctcaccacttccgcttggtggttgaaccgctcttcctgcaagaggttcatcagcgttcctgtacagccccccttgggatcaaatgcgccgaatacgaccttatcgactctcgaaagcacgacggctcccgcgcacatcggacacggctccaaagtgacataaagaacggcatcctcaagtctccatgtccccagcctacggcacgcttcgtctatcgccagcatttcggcgtgggcaagcgacctctgttcagtctcccgcagattatgcgcccgcgccacgatctcatcgtgcagaacaagaactgctccgatcggcacttcacctttcgcttcggctttcttcgcttcttttatggcttctctcatataatattcatcattcataggttcgagctctcttcttaagttttttcatgtctcataaaggttaaaataggaataccccagcagaaaggagttgccggtattgtctgaacctaacaacacagcccttctgattgtcgatatgatcaacaattttcaatttgatatgggcgaacgtcttgctgaaaaaaccaaacaaattgtcccccgtattttatcattaaagaagcatgcaaaacaaagcaactggccgattatttatattaatgatcattacgggctctggaaggctgatattgatgccatcagggaggaatgcagcaacgacagaagcgcccccattataaaagaaatttcgcctcagccggatgattattttctcattaaaccgaagcattccgctttttacgaaacagcgcttcacacccttctgaccgaattacaagtgaaccgattagtcatcacggggattgccgggaacatttgtgtgctgttcacggccaacgacgcctatatgagagaatacagcattgccattccgaaagactgcaccgcttccaataacgacgaagacaatgatttcgctttgaccatgatggagaatgttctcttcgcagaaataaccacggaaaaacaaattaccgccgaaaaataaacatgatcagcctccttttttcatatatttgatagcggatatgaaaggaggcgtttttcattcagatctatatagtgaaacggggcgacacgctttccgctattgcggcgcgctaccggactgccgcaaatgtcattgcggaagcaaataaactgcctaatccaaatacattggttgtcggacaaacccttgtcatcccgattgagggtcaatattacgaagtgaaacaaggtgatactctcgcggcaatcgccggccgttttcatatatcggccgcggagcttgcgagggttaacggaattcagcccggcaccacattgagagccggaacccgcctttacattccgcagcaggcgaataagcccgatatcgaatcaaatgcatatatagaaccgcggggaacgagcgtaagcgctaatctccaacaggcggcaagggaggcctctccttatttaacatacctcggcgcattcagttttcaagtgcagcggaacgggactttaaaggaaccgcctttgaccaatttaaaaagcatcagtgacaggcacaacaccacactgatgatgatcatcaccaaccttgaaaatgacgcattcagcgatgaactcgggcggctcatcttgaatgacaatacagtgaaaacaaaactctttcaggaaatcgtctccacggctaaaaagtacggctttcgcgatattcactttgatttcgaatatttacgtccacaggacagagaagcctacaatcgttttttacgtgaagcgaggacgatttttcatcgggaaggctggaagatttcaacggcgcttgctccgaaaacgagcgcgacccaggccggcaaatggtacgaagcacatgactatagggcacatggagaaatcgtcgattttgtcgtaatcatgacatatgagtgggggtacagcggaggcccggctcaggccgtatcacctatcggccctgtaagaaatgtcattgagtacgcgctgacggaaatgccttcttcaaaaatcgttatgggccagaacatgtacggctacgattggacactgccttttaaacagggaacgacagccaaagccgtcagtcctcagcaggcaatcgctctggcagcacgccataaagtcgacattcaatatgacgaaaccgcccaggctccattctttcgttacacggatgaaaatcagagacggcatgaagtatggtttgaagacgcacgatccattcaagcgaaattcaatttaattaaagaacttcatttaagaggaatcagctattggaaactcggcctttctttcccgcaaaactggcttttgctcaacgatcaatttcatattgtaaaagagacgtttcgttaattggaagcgtcttttttcatgggcttttctgagagtgtgatacaatataaaggccggcagctgacggatgtttacagaattaaggaggattttcaatgaacagagccccttttatcgcggtagaaggtcctatcggggcaggaaaaacgacactcgctacgatgctttctgaagagctcggttttcctatgattaatgagattgtggaagacaacccttatctcgataagttttatgacaatatcgaggagtggagtttccagcttgaaatgttttttctatgtcacaggtataaacagcttgaagacaccgatcgagattatttaaaacaaggacagcccgttttgtccgattatcatatttataaaaatgttattttcgcagagcgtacattgcacggccaaaagcttgagaagtataagcagatttatcatctgctcactcacgacctgccgaaaccgaatatcattgtatacataaaggcaagcctgccgacattgcttcaacgcattgaaaaacgcgggcgcccgtttgagaaaaatatcgagcatcaatatctggaacgtctcattgcagattacgacacagccatcagacagcttcaggaagaagatccggatatatctgtactgaccattgacggtgatactgaagactttgttttgaataagacagactatgaaagaattgcccgtcaggtaaaggagcttattaaatgaaagacattcatattccaaacaacgccattatcacagtagcgggaacggtaggagtcggaaaatcgactttgaccaaagctttagcaaaacggctcgggtttcatacctcacttgaggaagtggatgaaaacccttatttagagaagttttatcacgattttgaacgctggagcttccatttgcaaatttattttctggctgagcggttcaaagagcagaaaaacatgtttgaatcaggcggcggattcgtgcaggaccgttcgatttatgaagatacaggcatattcgcaaaaatgcatgccgataaaggaaccatgtcgctgacagattacacaacatacacaagtctatttgaggcgatggtcatgacgccgtacttcccgcatcctgatgttttgatctatttagaaggcgaccttgaaaacattataaaccggattgaaaagcgaggccgcgagatggagctgcagacaaaccgctcctattgggaagagatgtatacacggtacgaagactggatcagcggttttaacgcctgccctgtgctaaaagtgcgcattgaagattatgaccttgaagctgatgaacagtcactggaacctttgatcgaaaaaatcagccgcgtgatcaacgaaaacagaaataaataaaaatagcaaagcgattttccccgaacagagaaaatcgctttttttgcatataaaaaatccgctgcatcacatgcagcggacaaaacaatctccaatatatgctcgagtttcattaggtttaaaatcaatatggcggaggaagagggattcgaacccccgcgggctttgacacccctgtcggttttcaagaccgatcccttcagccagacttgggtattcctccgtatcgacatttaataatataccacatgacctaaatttcagtcaagcgctttttcatattttttatttcatttcttaaacagcttgtccgtcagctttactatcatacaaaagtcttgcgtccaattcaacctcagtatgccatacgggcaggaaaacacagtaaaaatcaagaatagattcaaacagataacctgctcataaaggtggagaacataatgaaaatcattattgcaccggattctttcaaagaaagcatgacatcaaaagaagccgctgacagcatagaaaaaggattcaaagcggtcttccctgacgcggaatatatcaagatacctgcggccgacggcggagaaggaaccgttcaggctttgacggatgccactggcggaagcatcatcaaaaaaactgtgaccggtccgctgggaacgccggtaaacgccgcatatggacttctgggagacggacgcacggcagtcattgaaatggcggaagcatcgggacttcatctcgttccccgccatctcagagatccgttgaacacaacgacaagaggaacgggtgaactgatagcagatgcagcttcccgcggggcgggtgagatcatcatcgggcttggcgggagcgcaaccaatgacggcggaacaggaatggcgagcgcgctcggtgtgcgtttcttaaatgaggaaggtcaggagatacctgacggcggaggcgctctgcacaccctagcttctattgatataagcggtctctctcctgatctgaaacatatccgtatccgtgccgcatgtgatgtcgaaaatcctctgaccggtaaaaacggcgcgtcatatgtcttcggcccgcaaaaaggggcatccgagaagactaaagttgtattggatcgcaacttacgccatttcgctgacgtattgagacgtcagcacaatatcgaagcggataccgtaaaaggcgcgggcgccgcagggggactcggcgccggactgatcgctttcttacaggcagaacttcaaagcgggattgacgttgtattagatacactgtccttctcagatcagataagaggcgctgaccttgtcattaccggagaggggcagatagacggacaaacgctattcggcaaaacccccgccgggatcgccgcacgcgcatctgctcaagaaattcccgttatcgcattggcgggctccttaggcaaaaatttcgagcatgtttacagcgcaggaataacggctgtgttttctatcgtgcccggcgctgtaagtcttgaagacgccttagcatccggccgttttaaccttgaaagcactgcccggaatgccgccgctctataccgggcagcaaaaaaggcgcgcctctagggcgcaccttttacggtttgatgacttctttatttcccatataaggacgaagcactttcggaatgatgacacttccgtcttcctgctgatagttttctaagatggcagctactgttctgccgactgcaagacctgaaccgtttaatgtatgcacatgctccggcttgcctttcgcttcgcgtctgaatcgaatgtttgcgcgtctcgcctggaaggcctcaaagttactgcaagaagaaatttcacggtatgtgtcttggcttggaatccatacctcaatatcgtactttttcgcggctgtaaagccgagatcaccggtacacatgctcatgacacgatacggcagttcgagcagctgaagcacccgctcagcttgattcgtcagtttttcaagctcctcataagaatcttccggcttcacgaatttcacaagctcaaccttgttgaactgatgctggcggatcaaaccgcgtgtatcacggccggcagatcccgcttctgaacggaagcaagcgctgaatgcggcataattgatcggcaggttctcaccggataagatttcatcgcggtgcatatttgtaatcggcacttccgccgtcggaattaagaaataatcttcttctctgattttaaaagcatcctcttcaaatttaggaagctgtcccgtacctgtcatgctcgtacggtttaccatataaggaggaatgacttccgtgtaatcatattcatcaacgtgaagatccagcataaagttgtagagcgcgcgttcgaggcgggcgcctaatcctttataaaacacaaaccggctgcctgttacttttgaagcgcgttcgaaatcaagaatgtttaaatggtctgcgatatcccaatgcggtttcggctcatatgaaaatgccggcgcctctccccacttgcgaatttcaatgttatcatcttccgtttccccgacgggcactgagtcgtgcgggatgttcggaatagacagaaggatggtttcgagcgtcgtttcgacagtacgaagctcttcatcaagcttcttaatttcttcgcccacttcgcgcatctctttaataatatgatcagcgtcttttttctcccgtttcaaaacggcgacctgctgagatacttcattgcgttttcccttcagttcttctactttaccgataagctctcttctcttttcgtccagctcttcaaacttgtcaaagtcagataagtcttcgccttttggaatgagcttcgcttttacctcttgaaaattggctctcagcaccttcgtatcaatcatgcctaacaactcctatctgtttttatcgaaaataaaaaagagccctcatcccctaaaagggacgagagctctcgcgttgccaccctgattgaaaacaagctcacacttgcttcccgctttaacacataacggttttcccgtaaatgcctactagttttcagcatttcgctcaaggacggattcggacagcatctttcaccgattcgcaccacccatcggctctctttgaaagagaggctccctactgcttcctgtcaacgcttttcgatctttatttgtgtttataatgtactataagtatcagcggttttcaactgttttatacagctgtttcctgcttatgcttttccgccatcttcacaaacagctctgtcacccggtgatcatccgtcagttcaggatggaacgagcagccgaggaaattcccctgctttgcagccacgatgcgtccgttatgctcacaaagcacttcaacatcttctccggcttctaaaatatgcggtgcgcgaataaatacacccgtaaacggctcatcaaggcctttaatcgtcagatcagcttcaaagctgtcaacctgacggccaaaggaattacgctcgacgacaacgttcaacagccctagatgagcgttatccgttcccgctatctctttggctaaaataatcagaccggcgcatgtgccgaacatcggcttgccttgggcggcaaactcgcgaagcggctccataaaatgatatgtatccattaaacgccgcatcgtcgtgctttccccgcccggcaggattaaaccgtcgatgtcattcagctgttcaggacgcttaatgacgacaccttttgaaccacatgcttcaattgaacgaatatgttctcttactgctccttgaagtccaagtacaccaattgttaacatgcttccagctctcctatggttttaccagccgcgttcttgcatacgctgttccggcaatagatttgagatttcgatgcctttcattgctgtgcctaattctttagaaagctcagcgatcagtttgtagtctgtgtaatgagtcgttgcttcaacaattgctttggcgaatttagcagggttgtctgatttgaaaatacctgaaccgacaaatacgccgtcagcgccaagctgcatcatcaatgccgcgtcagcaggcgtcgctactccgccggcagcaaagttcactacaggcagtttgccgtcacgtttgatttgaagaagcagttcataaggagcgccgaggtttttagcttcagtcatcagctcgtcatcgctcatcgcaacaactttgcgcacttgcgcgtttacttttctcatatggcggacagcttccacaatgtttcctgttcccggttcgccttttgtacgaagcatggaagctccttcggcgatacggcgcgttgcttcgccgagatcacggcagccgcatacgaacgggactgtatattcgtttttatttaaatgaaattcttcgtcagccggagtcagaacttcactttcatcgatgtaatctactcccattgcttcaaggacacgcgcttcaacgatatgtccgatacgcgcttttgccattacgggaatggatacagcattcattacttcttcaacgattgtcggatcagccatgcgggcaacaccgccggcagcgcgaatatcagccggaacgcgttctaacgccattacggcaacagctcccgcctcttccgcaatcttcgcttgttcagcatttacaacgtccatgatgacgccgcctttttgcatttccgccatgccgcgttttacacgatcagtacctgtttgagccattatttggtccccctagtcaatgtatagttagataatttctatctcttattgtatcccagaaatacaatatttcatatgggtattcttattttatagcgagatgaataagatagatatcatttttttactaataatttggttttttcagtatattaagcaaaagagccctaactttcatcagagctctttcttatttctaaaaccagcctgttaccgtgtcaacggcgctgttccagataccggagaagaatccgccgatgccgcgcatcatctgaacaaaccagtttgctttatctacatcatttttcgtaacaagattcacgctgaactctttggttttgaggaagccatagtctttgtcactgcctttgtatgtaactgtcagcgttccgactttcgttccctttttcacaggagccgtgatttcttttttatctaaagtcacttcggctttatagttcttttcatccccgcttttcacaggaatagaaagcgccttgtcagtaacaatatcgacttgcttgtctttccctttttcaacgtcaatcgttttgtgcccttttacttgagagccttcagggtaaagatctttcattgagaaattgctgttaaatgcgtaatcgagcatttttttcgtttcatcaaaacgtccggtatgcaggttgccttttgcgtctaatacaacggtgatgacccgcattccgttccgctgtgctgtgcttgtaaaacaagatcccgcagaatcagtagaacccgtttttaagccgtcaacgccagggtattcagaaacaagaccttttaacatgaagttccagttcggcatgtccatttcatcatcagtgccggctctgaatttcgtcttagcgatgcttgttgttttgagaacttccggataatcagtgatcaggcggtctgcaagaagcgccatgtctttagcagaaacttcactttcttctttaacgccttctccttgcggctgcttgccgtgaaggtcttcattcacaagccctgtggcatttttaaagtcatagtttgtcatgcctaattctttggctttcgcattcatttcagcgacaaatttcgtttcagttccggcaagaatttcggcaactgcaatcgcggctccgttagcagagtaaatcgccatagcctgatacagttctttaaccgtgtatttgccgtcttttcgaagggggacgtttgataaactgttgtcttgagaaatttcatagacataatcatcaggagtatacgtttgatcccatttcacttttccttctttaatggcttccagaagcagatattcagtcatcatttttgtcatgctggcaatcggcagtcttttgtctgcatttttactgtataaaatttttcccgatgaagcctcaatcattatcgcagctgatgcgttgacatcaatcgggtcattgccggctgcctccgctttagacatcggaacaaagcaagttgcggccagtgccagtaccactaatgacaccaacagctgtttccatttcgtgatgttcaatcttacgacctccgtcattcattttaaatctataattaagccgttaaggacatattcaaattcaaaacacaacagtataaattttatcacactcgatataaaaaaaatagacagagtcagcgaccctgtcaaatgttttttatttgtaacaattatgagattgtatagtttggtgattctttcgtaatttggacatcatgcggatgactttcgcgaagtccggcacctgtcatacggatgaattgagcctcttctcttaaagcgcgcaagtcttttgaaccgcaatatcccatacctgaacgaagaccgccgacaagctgatacactgtttcttctacaggacctttgtacggagtccgtccttcgataccttcagggacgaatttcttattttcttcttggaaatatcggtctttactgcctttttccatggcagcgacagaacccataccgcgatacactttaaatcttctgccttgatagatttcagtctctcccgggctttctgaagtaccggcaagcaggcttccgagcattacagcatgtccgcctgaagccaacgcttttgtaatatctccggagaatttaataccgccgtctgcgataattgtcgcgccgtgttttctcgcttcagtggcacaatcataaatggcagtgatctgcggtacgcctacacctgcaacgacgcgtgtcgtacagatagaaccaggtccgattcccactttgacaatatttgctccggcttcaatcagagcttttgtcgcttcagccgttgcaacatttcctgcgataatgttcagttcaggatatgtttcacggattttcgcgactgtgttcagtacgcctctggaatgtccgtgagccgtatcaaccacgataacgtcgacattcgcttcaacaagcttgctgacgcgtgtcattgtatcgcctgtcacgcctaccgcagcgccgacaataaggcgtccgtgttcatctttagatgaattcgggaattcgataaccttttcaatatctttgatcgtaataagaccctttaatttgttttggtcatccactaacgggagtttttcaattttatgtttctgtaagattttttctgcttcgtctaatgtggttcccacagaagccgtaaccagctcttcttttgtcatgacatcactgattttcattgaataatcagagataaagcgaagatcacggtttgtaatgataccgacaagcttttgatcgtctttattatctacgatcggaacaccggaaattctgtatttccccatcaaatgctccgcatcgaatacttgatgatcaggtgttaaaaagaagggatttgtaataacgccccgttcagaacgtttgactttgtcaacatgttcagcctgctgttcgatggacatgtttttatggataatgcccaagccgccctgtctggccatcgcaatcgccatagctgattctgttactgtatccattcccgcactgatgacaggaatattaagctttaacgtctttgtcagttcaacagataaatccacatcacgcggaagtacgtctgattgagccggtacgagcagtacatcatcgaacgttaagccttcttttgaaaatttactttcccacattagtaaatccccctcttttcggcaaaatattatatgtagattatcaactagaaaacagcatgtcaaggaagcgaaaaagagttgaaatatttagataaaggaaagggtttaaaaatacatatgagagatcatgagtggaaagagttatcattattttattctgtagaatcttcccagaaatttctaaataaagtctatacagaaagcagcatggaagaaccaaaacgatatgcgtttaagaacagtgagcgcttcatattctttatcaaacacgccgagtccttctataagcaggcatctctttcccctttagaaattaagcctattctgttgttttacgggatgtcacaattgctgaaagcctgtcttctgaccacagatccaagctatccaagccacgcctcagtactcgcgcatggcgtgactgcccggaaacgcaaaaagcaaaattactcctttagggatgatgaagtgaaggtgcagcgcaatggtttatgtattcatgtaatgaagcacttattcgggatagctggtcttgaggaagaacggtacacaatgaagaaattgctgacagccatacctgaattgcatactgtcttttacttccaagagaaaaagaattggctgacccgtgtagagctgaaagatgaccttatttcagtgcctgagcatgcggtgattcattacaatatgtctgattcccgctttgctgaatatatcagccatcatttgaagtggtcttttctgaggaaagaccataaccacttggtttttgaggctgacccgatagacagagaaccttggtcttcgccaaatttattgtttcacttggagaaaaatcaatattacattccctctcagcgtgatcacttcctgcatcttccggaaatgattattcattatttggtcctctacaatatcgggatgattgcgagatatgaaacggagtggtggtatgaactgctgacacagcatgtcagtgatgattatgtgatgatccgccggttcttagaggtcacggaacgcaaatttccgtattacgtttctaatttcctgaagcagtacttataaacaaaaaaggcagctcatgatgagctgcctttaccgtaatgatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacacgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaagttccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagaactttgttgcttctctcgaagcgacctcttaatcataacattttcagtttgctaggtcaatacttttttaaaaaatattttcgctaggcttgcctttctattaaaaagacaacaaaaagaattatatcagtatcatcgctatgtgtcaaagctttttttcatttctttatatagtaaaagcgcagcctgttgcagctgcgctttttcgtttatacttcttccgtttcttccggctcttcttcattcttttccacaagcgccacagtggctacatgctcttgatcagacatgcggatcagacggacgccttgtgttacgcgtcccgtagtggaaatatcattaatatccattctgattaacacgccgcttgccgtaataatcattaagtcctcttcgccttttgttgctttcacggttactaacggaccgttgctgtcagtgattttacatgttttaaggccttttccgcccctgctttgaactctgtattctgaagccggtgtgcgtttgccgtagccgttttctgtcactatgaggacatgggagtcttcttcaagaatctccatgcctactacgacatcatcgtctgtcagcgtgatgcctttaacacccgcagctgtgcgtcccatttgtcttacatctgcttcagggaaacggatcagcaaaccgttcttcgttccgatgatgatttgtttcttgccgtcagtcaggcggacggccatcagttcatcgtcttcccggagacctagggcgatcagcccgttattccgtatattcgcaaactgggacagtgccgtacgtttcgacaccccttgtttggtcgtaaagaagaggtattgctcctcatcaaacgtgctgaccggaataatagcattaatccattcgcctttttcaacctccagaaggttaataatcggaatgccttttgccgtacggccgtattcagggatttcatatcctttagaacggtataccttccctttattagagaagaacaggatcgtatcgtgcgttgatgtggaaattaagtgttccacaaagtcatcttcattcgttcccattccctgtacgccttttccgccccgtttttggctgcggtatgtggacgccgggagacgtttaacatagccgttatgggtcagtgtgatgacgatattttctctctcgataagatcttcatcttcaattgtttcaagaccggacgtcacgatttcagtgcgtctctcatcattgaaacgctctttgatttcattgagctcttcacgaatgatctcaagaactcttgcttcattggctaaaatatctttcagctcggcgataagcgcaacaagtgattgatattcctcttcaatcttttcgcgctccagaccggttaatcgctgaaggcgcatatccagaatggcttgcgcttgtttttcagtcagtgagaattgttcgatcaaacctgttctcgcaatttcagccgtctgggaattgcggataagagaaataacggcatctaaatgatcgagagcaattcttaaaccttccagaatgtgagctctcgcttccgctttgcggagttcgtaagccgttctgcgccggatcacaaccttttggtgatcaagataatgctccagacattgtttcaggcttagtaccttcggctgtccgtcaacgagcgccagcaggttgattccgaaagacgtctgcagggccgtttgtttgtacaggttattcaaaatgacgtgagcattggcgtcacggcgaatctcaatgacgattctcattccgttacggtcggattcgtcacgcagatccgtaattccttcgatttttttgtcccggacaagatctgcgattttttcaattaatctcgctttgttcacctgataaggaagttccgtgacaataattctttcttttcccgatgatgtctcttcgatttcagccttagcccggatcgtaatggatccccgtccggattcatatgccttgcggatgccgctccggcctaaaatctgacctgcagtcggaaaatccgggcccgggatgtattccatcagctcctggtttgtaatctcaggattctcacttacggcaagcacgccttcaatgacttccccaagctgatgcggaggaatatttgtcgccattccgaccgcaataccggcagctccgttgacgagcagattcggaaatctcgaaggcatgacgacaggttctctttctgcgccgtcatagttatcttgataatcaatcgtatctttcgtaatgtcccggaggatttccattgcgatttttgacattctcgcttctgtgtaacgcatcgcggccgctgagtcgccgtcaaccgaaccgaagttgccgtgtccgtcaacaagcatgtagcggtagttaaaatcctgcgccattctgaccattgattcgtaaaccgctgagtcaccgtgcgggtggtacttaccgataacttcaccgacgatacgggcagattttttatatggtttgtcactggtcatgcctaaatcattcattgcgtacaaaatccgcctgtgaaccggcttcagaccgtcacgcacatccggaagcgcccgggagacgataacgctcattgcatagtccaggaaggatgtccgcatttcctgactgatattgacttcacgtacttgtggtgtgttttgttcactcattaaaaaaacctccctgaagtatcacatgaaataatgtgggagtagattgtccattatgatcttcaatacgatttcactattctccattatatcaataaacttgtgtttatacacattaatttagtagaatatacgggttttgcgggttttcagaggctttagaagccgctttgagaaaaaagccttatttcttaacgaaaataaggctttcttggttaaatatcaagatttttcacgtatctggcgtttgcttctataaagtttctccgcggttctactttgtcacccatcagcatttcaaaagtctcgtcagcgtccattgcatcttcaagattgacttgcagaagcgttctggtcgcagggtccattgtcgtttcccaaagctgagtcgcgttcatttctccaagacctttataacgctggaggccgggcttaggtgattgcggaagctcttttaacagctcatcaagctgcttatcgttataagcgtattccacccgttttccctgctgcactttataaagcggcggctgggcaatgtagacatagccgttttcgatgatttcccgcatgtatctgtagaagaacgttaataaaagcgttctgatgtgggcgccgtcaacatcggcatccgtcatgatgaccactttatgataacgcgctttttcaagattaaaatcttctccgattcctgttccgagagccgtgatcattgatctgacctcattgtttgagaggatcttatcaagtctggctttctcaacgttcagaatcttaccgcgcagcggcagaatagcttggaaatgacggtcccgtccttgtttcgctgatccgcccgcagagtcaccctctacgatatacagctcggaaatgctcggatctttagaagaacagtccgccagtttgcccggcagattggaaatctcaagcgcacttttgcgccgggtcaattcccgtgcttttttcgctgccatccgcgctcttgcggccattaaacctttttcaacgattttgcgggctgagtccggattttcaagaaggaatgtttccagcgcagaagaaaacagcgtatcagtgatcgttctcgcttcggagttgccgagcttggttttcgtctgcccttcgaattgcggatcagggtgcttaattgaaataatggcagtcagcccttctctcacatcatccccgcttaaattcggatcattttctttgaaaatcccttttcttcttgcatagtcgtttatgacacgggtcagaccggttttaaatccggcttcgtgcgtcccgccttcgtatgtgttgatattattcgtgaaagaataaatattgcttgtatagctgtcgttgtattgcaatgcaacttcaaccgttatgccgtctttctcgccttcgatataaatcggctcttcatgaacgacttctttggaacggtttaagtactcaacatagcttttgattccgccttcgtagtggtactcgtttttccgttcttgtccttcacgtttgtcttcaatcgtgatgtttacgccttttgtcaggaaggccaattcccggacacggtttgaaagcagatcatagtcgtatacggttgtttctttgaagatttccggatccggaacgaagtgcgtaatcgttccggtcttatcagtatcaccgatcacttcaagatcggccacaggtacaccgcgctcgtacgcctgatagtggatttttccgtcacgatgaaccgtaacgtcaagagtggtcgacaaggcgtttacgacagatgcccctacaccgtgaagaccgccggatactttatatccgcttccgtcaaatttaccgccggcgtggagaacggtcatgatgacttcaaccgcagggcggcccatcttctcctggataccgaccggaattccgcgcccgttgtccttaacggtaatgctgttatctttttcaatctcgatgttaatatctgtacaataaccggccagggcttcgtcaatactgttgtcgacgatttcccacaccaagtggtgaaggcctttgctgttagttgatccgatgtacatccccggtctctttcgaacagcttccaaaccttctaatacctgtatctgattctcatcataactattttgctgctgttccatagccatgcacattcacctacacttttcttaaacgatatattcattgtaaagatccgctaagaatctatttctaacataaattgcgcacgtttcttcagtgtgccggaagataagggagagtaatatatattctcagtcgtgactacgatagactttggcgtgccgtttacggacggcactactttttctttctgtctgtccagaaattcttcaacgatcggcgatacattgaccttgcagtcaaaaatgccgacgatatcgcgtgttgaaacgacaaagtcgtcacctaaatgaatatacaatcgctcacctcatttcttcacttcactaacgtaccgttttccacacggaacattcctgcttgatgtaaggtatcgtggtcaatgccatccacgcttgtcgtggtgacaaatgtctgcacacggccttggatcgtatgaagcaaatgggactgtcggtaatcatccagctcgcttagtacatcatccaaaagtaaaatggggtattctccgatttcttcatgaatcaaatctatttcggccagcttcaaagacaaagccgtcgtacgctgctgtccctgcgaaccgtacgtctgcacatcgcgtccgttcacataaaaaaggacatcatcccgatgcggtccgaataatgtgacgcctcgttctatttctttttcttttaatttcgaaaaagactcctggtagctgttacctattttcgacaaatctttgggatctgatacatcaagcgccgtgtggtacttaagcgtcagttcttcaagtccccgggaaatgccggaatggatcggctgcgcccatttttcaagctgcgccgtaaactgcagacgtttggcgacaacttttgcggctgcttcaatcagctgatcagtgagaacgtcaagcatggtccggtcagtctgtttccggctttgcagctgtttcagaaaatgattccgctgtgaaaggattttttgataaagagataaatcatacagataaacggcagaaacctgcccgatctccatatcgagaaatctcctcctcacctgggggcttcctttgacgagatttaaatcctcaggggcaaacataatggtgttcagcgctccgacatactgactgagtttttgctgctctatatgattgaccttgccctttttaccttttttggagatgacaagctgcatcgggatatccccgtttcgcttcatcactcttccttctattttagcatagtcttcgtcccaccgtataagttctttgtcatttgaggtgcggtgtgattttgccatcgaaaggacatagatggcttccatcagattggttttgccttgggcattttccccgatgatcacattcaccttgttttcgaattgaagctcagcgcgctcataattacggtaggatgttaattctaaattttggatatacaaccgctgtcacccgctttaattgacgacttgaaatgaaccaaatccttcaatcgcgaccacgtctccaacgtaaagctttctgccgcggcgattgtcaggttcattgttgacagtcacctcatgctcgctcagaaaccacttcgccatgccgccggactgaatcacatctgctaattttaaaaactggccaagcgtaatcatttctgtatcaatcgaaatcggatttgccatattatcgacctctttcaaatatcactaatatctaattgtactaaaaaatcctgaaataaggaaagggaaaacttgagggagcggctgatgaatagaaaagctgccgaactaagccggcagcacattctgtttgattaatacgttctgaccggaaggatgagctgaacgatggtttcatcattcggcgtacggataagaaacggtctcatcgctcccgtaaaactgatacggatgtccgctccttcaagtactttcagtgcgtccatcatatat

SEQ ID NO: 263 - protein, 136 aa, Bacillus amyloliquefaciens
MNTAYRVWDGEQMHYWDDEGLSLTIKNNGDWTLKRLYTDVLVPVVDSTNRNAALMWGTGLKDKNEKMIYEKDVIKFKSVYCENKIIKAVVKFRDSLGSFVFNRGDDQDFWRMDVSLSEIEVIGDIYQNPELLEGAE

SEQ ID NO: 264 - protein, 63 aa, Bacillus amyloliquefaciens
MKIAKVNNNNVVSVLKEGNQELVIMGRGIAFQKKTGDPADEARIEKVLTLDNKDVSEVQNPFV

SEQ ID NO: 265 - protein, 134 aa, Bacillus amyloliquefaciens
MKNGYAKTLSLGIQHVLAMYAGAVVVPLIVGAALGLNAEQLTYLVSIDIFMCGAATLLQVWRNKCFGIGLPVVLGCTFTAVAPIISIGKEYGISAIYGSILASGLLVILLSFFFGKLVSFFPPVVTGSVVRIID

SEQ ID NO: 266 - protein, 842 aa, Bacillus amyloliquefaciens
MKRKKDGLSKQVHIYSVDTSAFYNDKENSLHNKILKSYRYRDYLKTLDNVNNKHKKYISQRITYLKECLYSAFEEHNDIRTLRTDSLRDNKVISLFDSVLTRTLGIKENTLSEEIMVVQTYHFEVLKDIIDQGFLHNNEKYVYFTSSAGQIRTKKSCFIKKSTYDKYQDALTCGLSIEKINSLGGSSINKWNSYMALSNSASSPWEIDIDKAIVVDDLETDVSSLVDYIDRDTYEITRKTMNIPIEHTDGCGMILPTLSSKSFMVRLPWVKGLLVPFDFRKFAEENKAFKVTDIYGKEWDVVKDDVQIIFTKSQFKMWKYYSSWEEYQGNYKKYGCLGAKLNEEDPSVEGKLTYQMLQTLTDISGEELIQMSSKTVKEITTLGTDKETMLRVLGATEKKKHRTALQDALLLYPELLNDDHTKEIIKNKKKSMIKDAKSGKLLVDGARYTYLCPDLYAFCEKLFLNIQNPKGLLSGNDVHCSLYDEGYIDILRSPHLFREHGVRWNKKDEKYEKWFITPGVYTSIHDPISKLLQFDNDGDKALIISDELIVNIAKRNMENIVPLYYEMSVAQKQKINSRNIYEALTLAYGINIGEYSNNITKIWNSDNINLDVIKWLCMENNFTIDFAKTLFMPTRPDHVDEKIKDYIKNKVPHFFINAKDKEEHSVELINESTVNKLDSIIPSDRINFAAVAGKFDYRFLLKNRDIKLDDAIIREYKRLDQNKKWLMNDEDIKPGQKLYVYKVIKDRLLKIYNDEQSVADVLVKHLYKKKSKFKSTLWECFGDLILENMQNNLKRFKSCYSCGKMFKSISNKSKYCNKCALEIEKKNHRLRQKKYSKKKMTK

SEQ ID NO: 267 - protein, 370 aa, Bacillus amyloliquefaciens
MFGFIGVGQAGGSIADEAMKRGFHSVAINYSLSDLNSLINIQDKLHLVGTEGVGKDRSVAAKHMKNNWESSIEFIKNTMEKPSVQVIFVVFSAAGGTGSGVAPILLELLNECLTHKTIVAVPILPDNNEVLVNQMNTLELLDDLSMPETCVLPLDNQMVLSKYEGKISESRLYKETNKMFLDLIEVLLNYTDRGSKISTLDRKDLNQLFDTPGIMTIAQTDLNEFTIEGKYFDKLHEDIQKSWNNSIFTPVEFTNVMRAGVILDVHEFLTEHISYNELFNVFDNKMPLDLFKGHYDKGNRAITILSGLTWINERMKQLDDLIESGNTEVKETTVYKAKNRRREDLFKPRKLENKESKKTSYMEALKRLKR

SEQ ID NO: 268 - protein, 382 aa, Bacillus amyloliquefaciens
MNLKQMIKNECEKDNQLAAKLSKIAGYKKVNGFYKFINTPEKEMDNLGGLINIVKSLFPDNEEQLLSDYFLSLDPNKKCARQSVEYSDINQWDTLTDKIVSRLSSSKNLASQEWGNIYSIHRRLSESKISLTDAIRATGKCKTDEMLFFSNAMLMYEYLKVGEFGLMKSTLSLLNFNDLPEGFVKDCYMNRISLLNANIYLNDNEIEKSRYYSEQVIQNSNINRLKVFGHLTYGNTLIFESYSKAKEQYLKGLEFARDNEHHKYKLRLALCFLSNLWNKDNKWLDFDTDNIPDKIEVAYYYTNNKEFNKAEKVINELENMELYEYDSGILDYIKGILYQNKNYFYESTAKLKKSGDKLFINLPLAELRKMGCDEKLLELIMV

SEQ ID NO: 269 - protein, 338 aa, Bacillus amyloliquefaciens
MDVYDLKNHIIEKPEYIVLILEQTGFYNVDERGNEYRCARKKGRNPTSVKVNKTTLGATCFSTNLKGDLITLVQNKLGLSFPKTIKRISEIVDYKSEEEYKPPELPFGGFYKNIRRLSNPMDLDLETYSDDILDQFVSVPNKLFYEDGILPLTQSLFQVGYDSVSGRITVPWKSLSGELCGVMGRLNKKEVNDEETKWLPIISFPKSKTLYGFVENYSSIREKSIVMIGESEKHSMALASKGLNVGVSLGGSFLSEIQANHIKSMFPKKSLVMMDEGLGEEHSVEIANSLKFENFFENEVGYIFDRENKYLPKGSKMAPADLDKSTLHRLIRDCTVWI

SEQ ID NO: 270 - protein, 67 aa, Bacillus amyloliquefaciens
MPKFWSYPEGLKVIINENAKNACPHHVGREGKIIELLHSATYDYAVSDETGDITFFKEHELNPAKGG

SEQ ID NO: 271 - protein, 172 aa, Bacillus amyloliquefaciens
MKKVIAIDMDQVLADLLSDWVAYINTYDDPFLKEEDILCWDISKYSNTQNNVYRHLDYELFRNLDVIEGSQRAVKELAKKYEVYVVTTATNHPESLKAKLEWLTEHFPYIPHSNVVLCGNKNIIKADIMIDDGVHNLETFDGMKILFDAPHNRNDNRFIRVMNWEEIERKLL

SEQ ID NO: 272 - protein, 396 aa, Bacillus amyloliquefaciens
MTEKYDKWTRLLDMIEPNYAFESAVVGNSIYVLGGARNQKYNKNYSFDTISQKWTQGLDIPTPRVGSCTAVIGNYIYVLGGYKGANVYSSVDVYDTKTNTWGRVPDIPTPTCHASAAVINDTIYLIGGFDTDAAHSQHYAFDTLSKTWSVKKAPPINIYATETEVFNGKIYLVGGQTKEVVQGHIRSDLNEYIYEYDPVMDRWNRKKFLGPLQNTSTAVLNNKIYIIGGRKNPSVIEPLTKVYDPIKDEISVEKPYPFERYDARIAAVGDNLYLFGGLTPSGYALEYLHALTPVKTEEDKDGEPKNPEEPPNKQPASNRAILLVTMTTGLEKEFDLSMEEIKDFIRWYDQKSSGIGLSRYVIEKHYNNIGPFQNRRDHIVFGNILTFNVSEYTLDK

SEQ ID NO: 273 - protein, 59 aa, Bacillus amyloliquefaciens
MAGYKKAAPRIARLLDYVPESDLADVPDPYYTGNFSEVYALVESGCRHLLETIKKDHHL

SEQ ID NO: 274 - protein, 84 aa, Bacillus amyloliquefaciens
MGKEVVPQAERVLNAIAELHGGIAFDFTSFPRSCEYYLEHGTMMPDDGLETLQHFDALFLGAVGNQKLVPDHVSLWGLPIKIRR

SEQ ID NO: 275 - protein, 347 aa, Bacillus amyloliquefaciens
MTNSVQQDKQVPKKYPQAAVMQMVSGLGFSLAVKTAVELDVFSAFQNGPASAEAIAEALELNPSALFRLLRALESVGLVAQAQNGYYDVTEYGATLMPGKAKSIEPLVEYLLHETVVQSMFKMDYSIKTGKSAFEAIYGDKWYENNSLDQDYLKTMDKAMEIYSKMSLPSILKAYSFEKFDVIVDVAGGMGQLITGILGVAPKSKGILFDLPKTIQSAKKHLASSEMSERCQFTEGSMFEEIPSGGDLYVISKVLNDWDDEHVVAILENIAGAMSDHSKLIIVENVPEADRLSPEEAFRDLLFLVCSAGGRVRKITEFEQLIEKAGLTLLNVIQTPSKYTILECGKK

SEQ ID NO: 276 - protein, 507 aa, Bacillus amyloliquefaciens
MKNTEENKTAIIIGGGIAGMAAGCYLQMNGYSTKIFEMGLLPGGLCTGWKRKGYFFDGCISWLVGSGPNNTFHKFWKELNVIQNMEFINDEEFAVVNFRNGDTFTLYADVDKLEQEFLRVAPEDAETIKLLTDGIRVVSDVELDLDKAPELFDLADFEAFKAKAGPYMKVMGQWGKVTIKEFAQRFKSSFVRENVNRLFWFNVDTPISYFMATLGWANSKSSGHPVEGSLQFAKIIEARYVELGGEIQYKSPVSKVLVENDKAIGIELKNGQCHYGDIVISAADGYKTIFEMLDGKYTDDELTFCYDNLKTSAPQIYVGLGVSKTFEKYPHYLSLELEQPLNAYGCDNVKNIFVKIYNENPSFAPDGKTSIIVYAKTSAEYWETLQKNNREKYEEEKKAIANVMIDELDKWFGEIKSNIDVTDVSTPYTIRRYTNNRNGSWQGWEKQMEGIMHEKKLKRSLPGLKDFYMVGHWSQVGGGLPSVVLQARNLVQVLCKEDGKVFETKIN

SEQ ID NO: 277 - protein, 234 aa, Bacillus amyloliquefaciens
MNSPLRCIEKINNAILFFNFIYNYSYHTIKNGSITLANEGDLMSIIAFLSYVLMTSITPGPSNILMMNEARRAGFIGSWRFNGGILTGFAVLGILSGLFTMSVYHWIPVVEPYFKIAGAVYLLYLAWQISLPKTSKGDSEKTRSSFLSGFLFQMINIKSILFFLTLMSAFILPFQHTYPLIAFWLASAILLGWAALLLWSAFGSVFKHLFEKHDKAFRIVMCLLLIYSAVSIYL

SEQ ID NO: 278 - protein, 211 aa, Bacillus amyloliquefaciens
MKKYLFSAGIIVLTVFTWVCTYSSLPDNLATHWGLNGSANDYQTKANAMMMLIGIMIILYILMVIIPKIDPKNNYKTFIRPYMAIFNTMFAVLFVINLITILTGLGYDLPISYLGNFIVGVIFMVFGNFIQIVKPNFFLGIRTPWTLSSESVWKDTHRVSSKLFVLAGMLMMLAAFLPPVYRVSVIFMAAIGCIILSLLYSYIVYQRQLNK

SEQ ID NO: 279 - protein, 136 aa, Bacillus amyloliquefaciens
MAKIGDGCLELEITPRRYHEAKDDPFISTTFELLEHNKAIARDYSAVLLESEYKMLISDIEALSAGNQDRIRLETIEPFFILSIDKENEHYRFIIRFMENHSNTTFYKLNCNEEKLEIFVKTLKSDLKDSKTLLGR

SEQ ID NO: 280 - protein, 290 aa, Bacillus amyloliquefaciens
MSELVFTRINTKINTSGPIILSMNAAELIVLAQEKVRKEEYINHIFIFRNGDGHLRHRYQIQTSMNIIGVQKSGDLFLFLIHKDYEDGVIQEDPNIYIWHPLKGFYHSLYGGRYIRSMTVDSANNLWLGYDEAGIFSCLDDDISSKGVARFPFEDGTWKSCSDTFRTAPHLIDHFYGAYAKKDAMYLHYRTLGEDYIRKVDLQGETLSFHRADFDFSAQFKKDSSYYFLIRNQASCQIDKALKFHNMTKQAGEYQLTDKISRKPLRFTQVAAYQDKAAGIDESNRLYLLS

SEQ ID NO: 281 - protein, 361 aa, Bacillus amyloliquefaciens
MASIEPRGKNSFRLIVENGYDAKGKRDRRKKTIRIEDPKLLKTKRKLQEYLEDQLHRFRIEVEAGEYIAPEKSTFDSFAEKWIEKKLFNKNGKPYSFTTSVKYSNHLKNHILPALGHKKIDKIKSLHIVDFIDDLSKDGARKDGKPGGLGDQTIKDIFKILQALFKTATEEWKLIKDDPIEGLSSPEAENKEMNFLESDEAAECIKVLYEIDIKWRLYYLAALIGGLRRGEALACEWHLDVDWDKGGIYVNRSISKTINGEPHVKSPKSKSSQRFVKMPDFYMNELAKYYRLWKKEKLLLGDAWEGGEHQYVFHSGKGKPYYYTTPTAKWTKIKKKYGLKDVRLHDLRHTMVALLMEAGES

SEQ ID NO: 282 - protein, 403 aa, Bacillus amyloliquefaciens
MNREKRLELKKVKPKHLQQFNQLLRYVFQVTNSNLHEVGWKEPEIASAKLPVLEQAHVLGWFDKDKLVSQAAVYPFQVRIFNKTFEMGGVTGVGTYPEYANMGLMAKLLYKALVDMRERGQSVSYLFPYSIPYYRRKGWEIISDKMTFEVKDFQLPKMSTVSGEVERVEPEHEVIKEVYSRFAHKSHAAMIRNELAWDEYWRWDLEELTAAVYYDQSRQANGYVLYWIADEVFHIKEMVYVNEEARRGLWNFISAHFSMVTKVVGDNYSNEPIAFLLEDAEIEETISPYFMARIVDIEQFINQYPFKPQKEKRTWSFTLEDPLLEWNQGVFTAEISPEGKAVLSPGGDADAAKLDIQTMTALLFAYRKPEYLHRTGRLECSPDTLEFIEDLLETQTPYFSDYF

SEQ ID NO: 283 - protein, 268 aa, Bacillus amyloliquefaciens
MEIETIVRESEANRIQAQTWFSHPEKSKVSFRYDERETSSIRSISIETFLSFYSSKFNREPYSVLDIGCGQGQVIQYLNSRFQKIELTGIDSSAQAISSAKKLGINASFICSNAENIMQYVSKKQDIIFIHLCFGLFKNPIAIVNTLIHLLSDQSCIYIVDLDRNSLGEGLNTAQSREEEAYLKDQYRASLTLEEFKQLLHVVTKEQHGVSFQVGNSFIGGFDETSSQFFSLMRNRNLQDALRTSVGEQFKQSQMPALLHGWIIKNKR

SEQ ID NO: 284 - protein, 336 aa, Bacillus amyloliquefaciens
MRKRTFHEAYTETLYDIYHNPEFFNSPRGQKSREQLNYHLTLENPIERVTYLSSRKTNIVFNFAEVLWYLSGSNDLDFISYYNKKMPSYSMNKKTLTGTAYGPKIFEFGNAKLNQWNRIKNLLTQEDIDSKRAFIQIFDASELFVLENIDVSCTIGLQFFVREGELYMSSVMRANDAFRGMISDLFSFTFMQELMARELRVEVGEYFHNAGSIHIYDSDHEWAKTVLEEAENHHDIPEFEFPKMPEGNNWPSIETVLKYEELLRKDQISMTKNDIEMLDLPDYWKQILFLFSIYQHIAYKRDMDHSLFQSLLPIYQFFVRNKWFHYFSTEQKEEIQ

SEQ ID NO: 285 - protein, 663 aa, Bacillus subtilis
MRKLYHGACYYPELWDEETIQQDIDIMREVGVNVVRIGEFAWSVMEPEEGKIDVGFFKEIIARLYDSGIETIMCTPTPTPPIWFSHGRPERMHANEKREIMGHGSRQHACTNNPYFRKKAAIITTAIAKELGRLPGLIGWQLDNEFKCHVAECMCETCLRLWHDWLKNRYGVIERLNEAWGTDVWSETYQTFEQVPQPGPAPFLHHASLRTMYQLFSMEMIASFADEQAKIIRCYSDAPITHNGSVMFSVDNERMFQNLDFASYDTYASQENASAFLLNCDLWRNLKQGRPFWILETSPSYAASLESSAYPHADGYLQAEAVSSYALGSQGFCYWLWRQQRSGSEISHGSVLSAWGEPTIGYQKVLAVERARKEIEPIILSTEPVQAEAAMTYSDRAKAFIKTEPHRGLRHRSLVTHFYERILNTGIHRDLIPEGAPLDGYRLLFTPFVPYLSSEFIKKASAFAEAGGIWITGPLTGGRTCEHTIHTDCGLGELEKTSGIKTLFTFPMNENVNTGKAFGITAPLGLWSAVFDTESGNTLGTVESGPGAGHAFLTEQNYGEGKIVMLGSLPSGKEGDAMLEALVRHYAEEAVISSRSDVTPGTIVAPRKGENGLVWIVVNMDGKGGSVTLPEAGTDLLTHRLEKAGRLAVGPHEYRVIQFDNHS

SEQ ID NO: 286 - protein, 686 aa, Bacillus subtilis
MSKLEKTHVTEAKFMLHGGDYNPDQWLDRPDILADDIKLMKLSHTNTFSVGIFAWSALEPEEGVYQFEWLDDIFERIHSIGGRVILATPSGARPAWLSQTYPEVLRVNASRVKQLHGGRHNHCLTSKVYREKTRHINRLLAERYGHHPALLMWHISNEYGGDCHCDLCQHAFREWLKSKYDNSLKALNHAWWTPFWSHTFNDWSQIESPSPIGENGLHGLNLDWRRFVTDQTISFYKNEIIPLKELTPDIPITTNFMADTPDLIPYQGLDYSKFAKHVDVISWDAYPVWHNDWESTADLAMKVGFINDLYRSLKQQSFLLMECTPSAVNWHNVNKAKRPGMNLLSSMQMIAHGSDSVLYFQYRKSRGSSEKLHGAVVDHDNSPKNRVFQEVAKVGETLERLSEVVGTKRPAQTAILYDWENHWALEDAQGFAKATKRYPQTLQQHYRTFWEHDIPVDVITKEQDFSPYKLLIVPMLYLISEDTISRLKAFTADGGTLVMTYISGVVNEHDLTYTGGWHPDLQAIFGVEPLETDTLYPKDRNAVSYRSQIYEMKDYATVIDVKTASVEAVYQEDFYARTPAVTSHEYQQGKAYFIGARLEDQFQRDFYEGLITDLSLSPVFPVRHGKGVSVQARQDQDNDYIFVMNFTEEKQLVTFDQSVKDIMTGDILSGDLTMEKYEVRIVVNTH

SEQ ID NO: 287 - protein, 718 aa, Bacillus subtilis
MVSIRRSFEAYVDDMNIITVLIPAEQKEIMTPPFRLETETTVFPLAVREEYSLEAKYKYVCVSDHPVTFGKIHCVRASSGHKTDLQIGAVIRTAAFDDEFYYDGELGAVYTADHTVFKVWAPAATSAAVKLSHPNKSGRTFQMNRLEKGVYAVTVTGDLHGYEYLFCICNNLEWMETVDPYAKAVTVNGEKGVVLRPDQMKWTAPLKPFSHPVDAVIYETHLRDFSIHENSGMINKGKYLALTETDTQTANGSSSGLAYIKELGVTHVELQPVNDFAGVDEEKPLDAYNWGYNPLHFFAPEGSYASNPHDPQTRKTELKQMINTLHQHGLRVILDVVFNHVYKRENSPFEKTVPGYFFRHDECGMPSNGTGVGNDIASERRMARKFIADCVVYWLEEYNVDGFRFDLLGILDIDTVLYMKEKATKAKPGILLFGEGWDLATPLPHEQKAALANAPRMPGIGFFNDMFRDAVKGNTFHLKAAGFALGSSESAQAVMHGIAGSSGWKALAPIVPEPSQSINYVESHDNHTFWDKMSFALPQENDSRKRSRQRLAAAIILLAQGVPFIHSGQEFFRTKQGVENSYQSSDSINQLDWDRRETFKEDVHYIRRLISLRKAHPAFRLRSAADIRRHLECLTLKEHLIAYRLYDLDEVDEWKDIIVIHHASPDSVEWRLPNDIPYRLLCDPSGFQEDPAEIKKTVAVNGIGTVILYLASDLKSFA

SEQ ID NO: 288 - protein, 407 aa, Bacillus subtilis
MKLAFICTEKLPAPAVRGGAIQMMIDGVTPYFSSRYNLTIFSIEDPSLPKRETKDGVHYIHLPKEHYREAVAEELRASSFDLIHVFNRPLNVSLYKKASPNSKIVLSLHNEMFSEKKMTFAQGKEVLDNVSMITTVSEFIKQTVIERFPEAEDITKVVYSGVDLNSYPPVWTMKGSAVRKTYRKKYGIEDKKVILFAGRLSPIKGPHLLIHSMRRILQQHPDAVLVIAGGKWFSDDSENQYVTYLRTLALPYRDHIIFTKFIPADDIPNLFLMADVFVCSSQWNEPLARVNYEAMAAGTPLITTNRGGNGEVVKDEVTGLVIDSYNKPSSFAKAIDRAFTDQELMNKMTKSARKHVEALFTFTHAAKRLNTVYQSVLTPKNKQFPPPFLTQNFDLSSINQLFVKAKT

SEQ ID NO: 289 - protein, 377 aa, Bacillus subtilis
MKIALIATEKLPVPSVRGGAIQIYLEAVAPLIAKKHEVTVFSIKDPNLADREKVDGVHYVHLDEDRYEEAVGAELKKSRFDLVHVCNRPSWVPKLKKQAPDAVFILSVHNEMFAYDKISQAEGEICIDSVAQIVTVSDYIGQTITSRFPSARSKTKTVYSGVDLKTYHPRWTNEGQRAREEMRSELGLHGKKIVLFVGRLSKVKGPHILLQALPDIIEEHPDVMMVFIGSKWFGDNELNNYVKHLHTLGAMQKDHVTFIQFVKPKDIPRLYTMSDVFVCSSQWQEPLARVHYEAMAAGLPIITSNRGGNPEVIEEGKNGYIIHDFENPKQYAERINDLLSSSEKRERLGKYSRREAESNFGWQRVAENLLSVYEKNR

SEQ ID NO: 290 - protein, 351 aa, Bacillus subtilis
MYQKEHEEQIVSEILSYYPFHIDHVALKSNKSGRKIWEVETDHGPKLLKEAQMKPERMLFITQAHAHLQEKGLPIAPIHQTKNGGSCLGTDQVSYSLYDKVTGKEMIYYDAEQMKKVMSFAGHFHHASKGYVCTDESKKRSRLGKWHKLYRWKLQELEGNMQIAASYPDDVFSQTFLKHADKMLARGKEALQALDDSEYETWTKETLEHGGFCFQDFTLARLTEIEGEPFLKELHSITYDLPSRDLRILLNKVMVKLSVWDTDFMVALLAAYDAVYPLTEKQYEVLWIDLAFPHLFCAIGHKYYLKQKKTWSDEKYNWALQNMISVEESKDSFLDKLPELYKKIKAYREAN

SEQ ID NO: 291 - protein, 353 aa, Bacillus subtilis
MAENHEVIEEGNSSELPLSAEDAKKLTELAENVLQGWDVQAEKIDVIQGNQMALVWKVHTDSGAVCLKRIHRPEKKALFSIFAQDYLAKKGMNVPGILPNKKGSLYSKHGSFLFVVYDWIEGRPFELTVKQDLEFIMKGLADFHTASVGYQPPNGVPIFTKLGRWPNHYTKRCKQMETWKLMAEAEKEDPFSQLYLQEIDGFIEDGLRIKDRLLQSTYVPWTEQLKKSPNLCHQDYGTGNTLLGENEQIWVIDLDTVSFDLPIRDLRKMIIPLLDTTGVWDDETFHVMLNAYESRAPLTEEQKQVMFIDMLFPYELYDVIREKYVRKSALPKEELESAFEYERIKANALRQLI

SEQ ID NO: 292 - protein, 421 aa, Bacillus subtilis
MKMAKKCSVFMLCAAVSLSLAACGPKESSSAKSSSKGSELVVWEDKEKSIGIKDAVAAFEKEHDVKVKVVEKPYAKQIEDLRMDGPAGTGPDVLTMPGDQIGTAVTEGLLKELHVKKDVQSLYTDASIQSQMVDQKLYGLPKAVETTVLFYNKDLITEKELPKTLEEWYDYSKKTADGSNFGFLALFDQIYYAESVMSGYGGYIFGKDKDGSYNPSDIGINNEGAVKGAALIQKFYKDGLFPAGIIGEQGINVLESLFTEGKAAAIISGPWNVEAFSKAGINYGITKLPKLENRKNMSSFIGVKSYNVSAFTKNEELAQELAVFLANEKNSKTRYEETKEVPAVKSLANDPAIMKSEAARAVTEQSRFSEPTPNIPEMNEIWTPADSALQTVATGKADPKQALDQAAETAKGQIKAKHSGK

SEQ ID NO: 293 - protein, 131 aa, Bacillus subtilis
MTDTRHMYGGPGFGHYQGFGIGHPGYGMYGGHPGFGMYGGYPDHGIHGGVGGYPGYGTYGGYGGSGGYPSGGYGGSPGTVNYPNMHHENDGHHHYYHHHHDGKDNLHHHHHDGHYGHHHHHMGHWGKDGYK

SEQ ID NO: 294 - protein, 50 aa, Bacillus subtilis
MVRNKEKGFPYENENKFQGEPRAKDDYASKRADGSINQHPQERMRASGKR

SEQ ID NO: 295 - protein, 258 aa, Bacillus subtilis
MSFFKKLAASAGIGAAKVDTILEKDAYFPGEEVQGTVHVKGGKIAQDIRYIDLQLSTRYVIVKDDEEHRKYATIHSFRVTGSFTIQPGEEHQFPFTFTLPLDTPITVGKVEVAVVTDLDIQGGIDKSDHDRIFVEAHPWIENVLEAIENLGFRLNEADCEQAPYFQRRLPFVQEFEFVPTSGYYRQMLDELELIFLLDEDGLEIIFEVDRRARGLRGWLEEMYNDGEQLVRVRFSQSELEDTEELEEVLEEILDQYAE

SEQ ID NO: 296 - protein, 49 aa, Bacillus subtilis
MGFGYGFGGGYGGGCYGGYAGGYGGGYGSTFVLLVVLFILLIIVGASFF

SEQ ID NO: 297 - protein, 82 aa, Bacillus subtilis
MDYPLNEQSFEQITPYDERQPYYYPRPRPPFYPPYYYPRPYYPFYPFYPRPPYYYPRPRPPYYPWHGYGGGYGGGYGGGYGY

SEQ ID NO: 298 - protein, 337 aa, Bacillus subtilis
MKTITIAAKEAKELVRQKLASAGLNERDAEKVADVLVHADLRNVHSHGVLRTEHYVNRLLAGGINPGAQPVFKETGPVTGVLDGDDGFGHVNCDMAMDHAIDMAKKKGVGMVTAVNSSHCGALSYFVQKAADEKLIGIAMTHTDSIVVPFGGRTPFLGTNPIAYGVPAKHKKPFILDMATSKVAFGKILQAREEGKEIPEGWGVDENGEAVTDPDKVVSLSTFGGPKGYGLSIVVDVFSGLLAGAAFGPHIAKMYSGLDQKRKLGHYVCAINPAFFTDWDTFLEQMDAMIDELQQSPPAVGFERVYVPGEIEQLHEERNKKNGISIARSVYEFLKSR

SEQ ID NO: 299 - protein, 494 aa, Bacillus subtilis
MFTMDDLNQMDTQTLTDTLGSIFEHSSWIAERSAALRPFSSLSDLHRKMTGIVKAADRETQLDLIKKHPRLGTKKTMSDDSVREQQNAGLGKLEQQEYEEFLMLNEHYYDRFGFPFILAVKGKTKQDIHQALLARLESERETEFQQALIEIYRIARFRLADIITEKGETQMKRTMSYGKGNVFAYRTFLKPLTGVKQIPESSFAGRSNSVVGVDVTCEIGGEAFLPSFTDGDNTLVVATDSMKNFIQRHLASYEGTTTEGFLHYVAHRFLDTYSHMDKITLTGEDIPFEAMPAYEEKELSTSHLVFRRSRNERSRSVLKAERSGNTITITEQYSEIMDLQLVKVSGNSFVGFIRDEYTTLPEDGNRPLFVYLNISWQYENTNDSYASDPARYVAAEQVRDLASTVFHELETPSIQNLIYHIGCRILARFPQLTDVSFQSQNHTWDTVVEEIPGSKGKVYTEPRPPYGFQHFTVTREDAEKEKQKAAEKCRSLKA

SEQ ID NO: 300 - protein, 221 aa, Bacillus subtilis
MKKFVSILFMFGLVMGFSQFQSSTAFAADKVVHETIIVPKNTTYDGKGQRFVAGKELGDGSQSENQDPVFRVEDGATLKNVVLGAPAADGVHTYGNVNIQNVKWEDVGEDALTVKKEGKVTIDGGSAQKASDKIFQINKASTFTVKNFTADNGGKFIRQLGGSTFHVDVIIDKCTITNMKEAIFRTDSKTSTVRMTNTRYSNVGQKWIGVQHIYENNNTQF

SEQ ID NO: 301 - protein, 112 aa, Bacillus subtilis
MKKKKMSPLFRRLNYFSPIEHHSNKHSQTTREDRDWENVYRNRWQYDKVVRSTHGVNCTGSCSWNIYVKNGIVTWEGQNLNYPSTGPDMPDFEPRGCPRGPVFHGISTARSV

SEQ ID NO: 302 - protein, 43 aa, Bacillus subtilis
MKKAVIVENKGCATCSIGAACLVDGPIPDFEIAGATGLFGLWG

SEQ ID NO: 303 - protein, 448 aa, Bacillus subtilis
MFIEQMFPFINESVRVHQLPEGGVLEIDYLRDNVSISDFEYLDLNKTAYELCMRMDGQKTAEQILAEQCAVYDESPEDHKDWYYDMLNMLQNKQVIQLGNRASRHTITTSGSNEFPMPLHATFELTHRCNLKCAHCYLESSPEALGTVSIEQFKKTADMLFDNGVLTCEITGGEIFVHPNANEILDYVCKKFKKVAVLTNGTLMRKESLELLKAYKQKIIVGISLDSVNSEVHDSFRGRKGSFAQTCKTIKLLSDHGIFVRVAMSVFEKNMWEIHDMAQKVRDLGAKAFSYNWVDDFGRGRDIVHPTKDAEQHRKFMEYEQNVIDEFKDLIPIIPYERKRAANCGAGWKSIVISPFGEVRPCALFPKEFSLGNIFHDSYESIFNSPLVHKLWQAQAPRFSEHCMKDKCPFSGYCGGCYLKGLNSNKYHRKNICSWAKNEQLEDVVQLI

SEQ ID NO: 304 - protein, 53 aa, Bacillus subtilis
MSPAQRRILLYILSFIFVIGAVVYFVKSDYLFTLIFIAIAILFGMRARKADSR

SEQ ID NO: 305 - protein, 436 aa, Bacillus subtilis
MNNIIPIMSLLFKQLYSRQGKKDAIRIAAGLVILAVFEIGLIRQAGIDESVLRKTYIILALLLMNAYMVFLSVTSQWKESYMKLSCLLPISSRSFWLAQSVVLFVDTCLRRTLFFFILPLFLFGNGTLSGAQTLFWLGRFSFFTVYSIIFGVVLSNHFVKKKNLMFLLHAAIFACVCISAALMPAATLPLCAVHMLWAVIIDFPVFLQAPPQQSKMHSFMRRSEFSFYKREWNRFISSKAMLLNYAVMAAFSGFFSFQMMNTGIFNQQVVYIVISALLLICSPIALLYSIEKNDRMLLITLPIKRKTMFWAKYRFYSGLLAGGFLLVVMIVGFISGRPISVLTFLQCIELLLAGAFIRLTADEKRPSFSWQTEQQLWSGFSKYRSYLFCLPLFLATLAGTAVSLAVIPIAGLVIVYYLQKQDGGFFDTSKRERLGS

SEQ ID NO: 306 - DNA, 20 bp, artificial sequence
  Primer 27F
  variation (12)..(12): m is A or C
agagtttgatcmtggctcag

SEQ ID NO: 307 - DNA, 20 bp, artificial sequence
  primer 1492R
cggttaccttgttacgactt

SEQ ID NO: 308 - DNA, 20 bp, artificial sequence
  primer 515F
  variation (10)..(10): m is A or C
gtggccagcmgccgcggtaa

SEQ ID NO: 309 - DNA, 20 bp, artificial sequence
  primer 806R
  variation (8)..(8): h is A, C or T
  variation (9)..(9): v is A, C or G
  variation (10)..(10): h is A, C or T
  variation (11)..(11): h is A, C or T
  variation (12)..(12): h is A, C or T
  variation (14)..(14): w is A or T
ggactachvhhhtwtctaat
